US010745677B2

(12) United States Patent
Maianti et al.

(10) Patent No.: US 10,745,677 B2
(45) Date of Patent: Aug. 18, 2020

(54) EDITING OF CCR5 RECEPTOR GENE TO PROTECT AGAINST HIV INFECTION

(71) Applicant: President and Fellows of Harvard College, Cambridge, MA (US)

(72) Inventors: Juan Pablo Maianti, Revere, MA (US); David R. Liu, Lexington, MA (US)

(73) Assignee: President and Fellows of Harvard College, Cambridge, MA (US)

( * ) Notice: Subject to any disclaimer, the term of this patent is extended or adjusted under 35 U.S.C. 154(b) by 167 days.

(21) Appl. No.: 15/852,891

(22) Filed: Dec. 22, 2017

(65) Prior Publication Data

US 2018/0179503 A1 Jun. 28, 2018

Related U.S. Application Data

(60) Provisional application No. 62/438,827, filed on Dec. 23, 2016.

(51) Int. Cl.
| | | |
|---|---|---|
| *C12N 9/22* | (2006.01) | |
| *C12N 15/10* | (2006.01) | |
| *C07K 14/715* | (2006.01) | |
| *A61P 31/18* | (2006.01) | |
| *C12N 15/113* | (2010.01) | |
| *C12N 9/78* | (2006.01) | |

(52) U.S. Cl.
CPC ............... *C12N 9/22* (2013.01); *A61P 31/18* (2018.01); *C07K 14/7158* (2013.01); *C12N 9/78* (2013.01); *C12N 15/102* (2013.01); *C12N 15/1138* (2013.01); *C12Y 305/04001* (2013.01); *C07K 2319/80* (2013.01); *C12N 2310/20* (2017.05); *C12N 2740/16062* (2013.01); *C12Y 301/21* (2013.01)

(58) Field of Classification Search
CPC ...................................................... C12N 9/22
See application file for complete search history.

(56) References Cited

U.S. PATENT DOCUMENTS

| | | | |
|---|---|---|---|
| 4,182,449 A | 1/1980 | Kozlow | |
| 4,235,871 A | 11/1980 | Papahadjopoulos et al. | |
| 4,501,728 A | 2/1985 | Geho et al. | |
| 4,737,323 A | 4/1988 | Martin et al. | |
| 4,837,028 A | 6/1989 | Allen | |
| 4,880,635 A | 11/1989 | Janoff et al. | |
| 4,906,477 A | 3/1990 | Kurono et al. | |
| 4,911,928 A | 3/1990 | Wallach | |
| 4,917,951 A | 4/1990 | Wallach | |
| 4,920,016 A | 4/1990 | Allen et al. | |
| 4,921,757 A | 5/1990 | Wheatley et al. | |
| 5,139,941 A | 8/1992 | Muzyczka et al. | |
| 5,449,639 A | 9/1995 | Wei et al. | |
| 5,580,737 A | 12/1996 | Polisky et al. | |
| 5,767,099 A | 6/1998 | Harris et al. | |
| 5,780,053 A | 7/1998 | Ashley et al. | |
| 5,830,430 A | 11/1998 | Unger et al. | |
| 5,835,699 A | 11/1998 | Kimura | |
| 5,851,548 A | 12/1998 | Dattagupta et al. | |
| 5,855,910 A | 1/1999 | Ashley et al. | |
| 5,962,313 A | 10/1999 | Podsakoff et al. | |
| 6,057,153 A | 5/2000 | George et al. | |
| 6,453,242 B1 | 9/2002 | Eisenberg et al. | |
| 6,503,717 B2 | 1/2003 | Case et al. | |
| 6,534,261 B1 | 3/2003 | Cox, III et al. | |
| 6,599,692 B1 | 7/2003 | Case et al. | |
| 6,607,882 B1 | 8/2003 | Cox, III et al. | |
| 6,824,978 B1 | 11/2004 | Cox, III et al. | |
| 6,933,113 B2 | 8/2005 | Case et al. | |
| 6,979,539 B2 | 12/2005 | Cox, III et al. | |
| 7,013,219 B2 | 3/2006 | Case et al. | |
| 7,163,824 B2 | 1/2007 | Cox, III et al. | |
| 7,479,573 B2 | 1/2009 | Chu et al. | |
| 7,794,931 B2 | 9/2010 | Breaker et al. | |
| 7,919,277 B2 | 4/2011 | Russell et al. | |
| 7,993,672 B2 | 8/2011 | Huang et al. | |
| 8,361,725 B2 | 1/2013 | Russell et al. | |
| 8,394,604 B2 | 3/2013 | Liu et al. | |
| 8,492,082 B2 | 7/2013 | De Franciscis et al. | |

(Continued)

FOREIGN PATENT DOCUMENTS

| | | |
|---|---|---|
| AU | 2012244264 A1 | 11/2012 |
| AU | 2015252023 A1 | 11/2015 |

(Continued)

OTHER PUBLICATIONS

Stephanie Pelletier ((Nov. 2016) CRISPR-Cas Systems for the Study of Immune Function. In: eLS. John Wiley & Sons, Ltd: Chichester. DOI: 10.1002/9780470015902.a0026896 [available online Nov. 15, 2016]). (Year: 2016).*
U.S. Appl. No. 61/837,481, filed Jun. 20, 2013, Cho et al.
U.S. Appl. No. 61/803,599, filed Mar. 20, 2013, Kim et al.
U.S. Appl. No. 61/794,422, filed Mar. 15, 2013, Knight et al.
U.S. Appl. No. 61/761,046, filed Feb. 5, 2013, Knight et al.
U.S. Appl. No. 61/758,624, filed Jan. 30, 2013, Chen et al.
U.S. Appl. No. 61/734,256, filed Dec. 6, 2012, Chen et al.
U.S. Appl. No. 61/717,324, filed Oct. 23, 2012, Cho et al.
U.S. Appl. No. 61/716,256, filed Oct. 19, 2012, Jinek et al.
[No Author Listed], EMBL Accession No. Q99ZW2. Nov. 2012. 2 pages.
[No Author Listed], Invitrogen Lipofectamine™ 2000 product sheets, 2002. 2 pages.
[No Author Listed], Invitrogen Lipofectamine™ 2000 product sheets, 2005. 3 pages.

(Continued)

*Primary Examiner* — Scott Long
(74) *Attorney, Agent, or Firm* — Wolf, Greenfield & Sacks, P.C.

(57) ABSTRACT

Provided herein are systems, compositions, and methods of introducing protective and/or loss-of-function variants of CCR5 and CCR2. Variants may be introduced using a CRISPR/Cas9-based nucleobase editor or other guide nucleotide sequence-programmable DNA binding protein domain-based fusion protein described herein. Further provided herein are compositions and methods of preventing and treating conditions related to HIV infection and progression as well as to AIDS.

25 Claims, 6 Drawing Sheets

Specification includes a Sequence Listing.

(56) References Cited

U.S. PATENT DOCUMENTS

| | | |
|---|---|---|
| 8,546,553 B2 | 10/2013 | Terns et al. |
| 8,569,256 B2 | 10/2013 | Heyes et al. |
| 8,680,069 B2 | 3/2014 | de Fougerolles et al. |
| 8,691,750 B2 | 4/2014 | Constien et al. |
| 8,697,359 B1 | 4/2014 | Zhang |
| 8,709,466 B2 | 4/2014 | Coady et al. |
| 8,728,526 B2 | 5/2014 | Heller |
| 8,748,667 B2 | 6/2014 | Budzik et al. |
| 8,758,810 B2 | 6/2014 | Okada et al. |
| 8,759,103 B2 | 6/2014 | Kim et al. |
| 8,759,104 B2 | 6/2014 | Unciti-Broceta et al. |
| 8,771,728 B2 | 7/2014 | Huang et al. |
| 8,790,664 B2 | 7/2014 | Pitard et al. |
| 8,795,965 B2 | 8/2014 | Zhang |
| 8,846,578 B2 | 9/2014 | McCray et al. |
| 8,993,233 B2 | 3/2015 | Zhang et al. |
| 8,999,641 B2 | 4/2015 | Zhang et al. |
| 9,068,179 B1 | 6/2015 | Liu et al. |
| 9,163,284 B2 | 10/2015 | Liu et al. |
| 9,228,207 B2 | 1/2016 | Liu et al. |
| 9,234,213 B2 | 1/2016 | Wu |
| 9,322,006 B2 | 4/2016 | Liu et al. |
| 9,322,037 B2 | 4/2016 | Liu et al. |
| 9,340,799 B2 | 5/2016 | Liu et al. |
| 9,340,800 B2 | 5/2016 | Liu et al. |
| 9,359,599 B2 | 6/2016 | Liu et al. |
| 9,388,430 B2 | 7/2016 | Liu et al. |
| 9,512,446 B1 | 12/2016 | Joung et al. |
| 9,526,724 B2 | 12/2016 | Oshlack et al. |
| 9,526,784 B2 | 12/2016 | Liu et al. |
| 9,737,604 B2 | 8/2017 | Liu et al. |
| 9,816,093 B1 | 11/2017 | Donohoue et al. |
| 9,840,690 B2 | 12/2017 | Karli et al. |
| 9,840,699 B2 | 12/2017 | Liu et al. |
| 9,873,907 B2 | 1/2018 | Zeiner et al. |
| 9,879,270 B2 | 1/2018 | Hittinger et al. |
| 9,938,288 B1 | 4/2018 | Kishi et al. |
| 9,944,933 B2 | 4/2018 | Storici et al. |
| 9,982,279 B1 | 5/2018 | Gill et al. |
| 9,999,671 B2 | 6/2018 | Liu et al. |
| 10,059,940 B2 | 8/2018 | Zhong |
| 10,077,453 B2 | 9/2018 | Liu et al. |
| 10,113,163 B2 | 10/2018 | Liu et al. |
| 10,167,457 B2 * | 1/2019 | Liu .................. C12N 9/22 |
| 10,227,581 B2 | 3/2019 | Liu et al. |
| 10,323,236 B2 | 6/2019 | Liu et al. |
| 10,465,176 B2 | 11/2019 | Liu et al. |
| 10,508,298 B2 | 12/2019 | Liu et al. |
| 2003/0082575 A1 | 5/2003 | Schultz et al. |
| 2003/0108885 A1 | 6/2003 | Schultz et al. |
| 2004/0003420 A1 | 1/2004 | Kuhn et al. |
| 2004/0115184 A1 | 6/2004 | Smith et al. |
| 2005/0222030 A1 | 10/2005 | Allison |
| 2006/0088864 A1 | 4/2006 | Smolke et al. |
| 2006/0104984 A1 | 5/2006 | Littlefield et al. |
| 2006/0246568 A1 | 11/2006 | Honjo et al. |
| 2007/0264692 A1 | 11/2007 | Liu et al. |
| 2008/0124725 A1 | 5/2008 | Barrangou et al. |
| 2008/0182254 A1 | 7/2008 | Hall et al. |
| 2009/0130718 A1 | 5/2009 | Short |
| 2009/0234109 A1 | 9/2009 | Han et al. |
| 2010/0076057 A1 | 3/2010 | Sontheimer et al. |
| 2010/0093617 A1 | 4/2010 | Barrangou et al. |
| 2010/0104690 A1 | 4/2010 | Barrangou et al. |
| 2010/0316643 A1 | 12/2010 | Eckert et al. |
| 2011/0059160 A1 | 3/2011 | Essner et al. |
| 2011/0104787 A1 | 5/2011 | Church et al. |
| 2011/0189776 A1 | 8/2011 | Terns et al. |
| 2011/0217739 A1 | 9/2011 | Terns et al. |
| 2012/0129759 A1 | 5/2012 | Liu et al. |
| 2012/0141523 A1 | 6/2012 | Castado et al. |
| 2012/0244601 A1 | 9/2012 | Bertozzi et al. |
| 2012/0270273 A1 | 10/2012 | Zhang et al. |
| 2013/0117869 A1 | 5/2013 | Duchateau et al. |
| 2013/0130248 A1 | 5/2013 | Haurwitz et al. |
| 2013/0158245 A1 | 6/2013 | Russell et al. |
| 2013/0165389 A1 | 6/2013 | Schellenberger et al. |
| 2013/0309720 A1 | 11/2013 | Schultz et al. |
| 2013/0344117 A1 | 12/2013 | Mirosevich et al. |
| 2014/0004280 A1 | 1/2014 | Loomis |
| 2014/0005269 A1 | 1/2014 | Ngwuluka et al. |
| 2014/0017214 A1 | 1/2014 | Cost |
| 2014/0018404 A1 | 1/2014 | Chen et al. |
| 2014/0044793 A1 | 2/2014 | Goll et al. |
| 2014/0065711 A1 | 3/2014 | Liu et al. |
| 2014/0068797 A1 | 3/2014 | Doudna et al. |
| 2014/0127752 A1 | 5/2014 | Zhou et al. |
| 2014/0141094 A1 | 5/2014 | Smyth et al. |
| 2014/0141487 A1 | 5/2014 | Feldman et al. |
| 2014/0186843 A1 | 7/2014 | Zhang et al. |
| 2014/0186958 A1 | 7/2014 | Zhang et al. |
| 2014/0234289 A1 | 8/2014 | Liu et al. |
| 2014/0248702 A1 | 9/2014 | Zhang et al. |
| 2014/0273037 A1 | 9/2014 | Wu |
| 2014/0273226 A1 | 9/2014 | Wu |
| 2014/0273230 A1 | 9/2014 | Chen et al. |
| 2014/0295556 A1 | 10/2014 | Joung et al. |
| 2014/0295557 A1 | 10/2014 | Joung et al. |
| 2014/0342456 A1 | 11/2014 | Mali et al. |
| 2014/0342457 A1 | 11/2014 | Mali et al. |
| 2014/0342458 A1 | 11/2014 | Mali et al. |
| 2014/0349400 A1 | 11/2014 | Jakimo et al. |
| 2014/0356867 A1 | 12/2014 | Peter et al. |
| 2014/0356956 A1 | 12/2014 | Church et al. |
| 2014/0356958 A1 | 12/2014 | Mali et al. |
| 2014/0356959 A1 | 12/2014 | Church et al. |
| 2014/0357523 A1 | 12/2014 | Zeiner et al. |
| 2014/0377868 A1 | 12/2014 | Joung et al. |
| 2015/0010526 A1 | 1/2015 | Liu et al. |
| 2015/0031089 A1 | 1/2015 | Lindstrom |
| 2015/0031132 A1 | 1/2015 | Church et al. |
| 2015/0031133 A1 | 1/2015 | Church et al. |
| 2015/0044191 A1 | 2/2015 | Liu et al. |
| 2015/0044192 A1 | 2/2015 | Liu et al. |
| 2015/0044772 A1 | 2/2015 | Zhao |
| 2015/0050699 A1 | 2/2015 | Siksnys et al. |
| 2015/0056177 A1 | 2/2015 | Liu et al. |
| 2015/0056629 A1 | 2/2015 | Guthrie-Honea |
| 2015/0064138 A1 | 3/2015 | Lu et al. |
| 2015/0064789 A1 | 3/2015 | Paschon et al. |
| 2015/0071898 A1 | 3/2015 | Liu et al. |
| 2015/0071899 A1 | 3/2015 | Liu et al. |
| 2015/0071900 A1 | 3/2015 | Liu et al. |
| 2015/0071901 A1 | 3/2015 | Liu et al. |
| 2015/0071902 A1 | 3/2015 | Liu et al. |
| 2015/0071903 A1 | 3/2015 | Liu et al. |
| 2015/0071906 A1 | 3/2015 | Liu et al. |
| 2015/0079680 A1 | 3/2015 | Bradley et al. |
| 2015/0079681 A1 | 3/2015 | Zhang |
| 2015/0098954 A1 | 4/2015 | Hyde et al. |
| 2015/0118216 A1 | 4/2015 | Liu et al. |
| 2015/0132269 A1 | 5/2015 | Orkin et al. |
| 2015/0140664 A1 | 5/2015 | Byrne et al. |
| 2015/0159172 A1 | 6/2015 | Miller et al. |
| 2015/0165054 A1 | 6/2015 | Liu et al. |
| 2015/0166980 A1 | 6/2015 | Liu et al. |
| 2015/0166981 A1 | 6/2015 | Liu et al. |
| 2015/0166982 A1 * | 6/2015 | Liu ................ C12Y 304/22062 424/94.6 |
| 2015/0166984 A1 | 6/2015 | Liu et al. |
| 2015/0166985 A1 | 6/2015 | Liu et al. |
| 2015/0191744 A1 | 7/2015 | Wolfe et al. |
| 2015/0197759 A1 | 7/2015 | Xu et al. |
| 2015/0211058 A1 | 7/2015 | Carstens |
| 2015/0218573 A1 | 8/2015 | Loque et al. |
| 2015/0225773 A1 | 8/2015 | Farmer et al. |
| 2015/0252358 A1 | 9/2015 | Maeder et al. |
| 2015/0307889 A1 | 10/2015 | Petolino et al. |
| 2015/0315252 A1 | 11/2015 | Haugwitz et al. |
| 2016/0015682 A2 | 1/2016 | Cawthorne et al. |
| 2016/0017393 A1 | 1/2016 | Jacobson et al. |
| 2016/0017396 A1 | 1/2016 | Cann et al. |
| 2016/0032292 A1 | 2/2016 | Storici et al. |
| 2016/0032353 A1 | 2/2016 | Braman et al. |

(56) References Cited

U.S. PATENT DOCUMENTS

| | | |
|---|---|---|
| 2016/0046952 A1 | 2/2016 | Hittinger et al. |
| 2016/0046961 A1 | 2/2016 | Jinek et al. |
| 2016/0046962 A1 | 2/2016 | May et al. |
| 2016/0053272 A1 | 2/2016 | Wurtzel et al. |
| 2016/0053304 A1 | 2/2016 | Wurtzel et al. |
| 2016/0074535 A1 | 3/2016 | Ranganathan et al. |
| 2016/0076093 A1 | 3/2016 | Shendure et al. |
| 2016/0090603 A1 | 3/2016 | Carnes et al. |
| 2016/0090622 A1 | 3/2016 | Liu et al. |
| 2016/0115488 A1 | 4/2016 | Zhang et al. |
| 2016/0138046 A1 | 5/2016 | Wu |
| 2016/0186214 A1 | 6/2016 | Brouns et al. |
| 2016/0200779 A1 | 7/2016 | Liu et al. |
| 2016/0201040 A1 | 7/2016 | Liu et al. |
| 2016/0201089 A1 | 7/2016 | Gersbach et al. |
| 2016/0206566 A1 | 7/2016 | Lu et al. |
| 2016/0208243 A1 | 7/2016 | Zhang et al. |
| 2016/0208288 A1 | 7/2016 | Liu et al. |
| 2016/0215275 A1 | 7/2016 | Zhong |
| 2016/0215276 A1 | 7/2016 | Liu et al. |
| 2016/0215300 A1 | 7/2016 | May et al. |
| 2016/0244784 A1 | 8/2016 | Jacobson et al. |
| 2016/0244829 A1 | 8/2016 | Bang et al. |
| 2016/0272965 A1 | 9/2016 | Zhang et al. |
| 2016/0281072 A1 | 9/2016 | Zhang |
| 2016/0304846 A1 | 10/2016 | Liu et al. |
| 2016/0304855 A1 | 10/2016 | Stark et al. |
| 2016/0312304 A1 | 10/2016 | Sorrentino et al. |
| 2016/0333389 A1 | 11/2016 | Liu et al. |
| 2016/0340662 A1 | 11/2016 | Zhang et al. |
| 2016/0345578 A1 | 12/2016 | Barrangou et al. |
| 2016/0346360 A1 | 12/2016 | Quake et al. |
| 2016/0346361 A1 | 12/2016 | Quake et al. |
| 2016/0346362 A1 | 12/2016 | Quake et al. |
| 2016/0348074 A1 | 12/2016 | Quake et al. |
| 2016/0350476 A1 | 12/2016 | Quake et al. |
| 2016/0369262 A1 | 12/2016 | Reik et al. |
| 2017/0009242 A1 | 1/2017 | McKinley et al. |
| 2017/0014449 A1 | 1/2017 | Bangera et al. |
| 2017/0020922 A1 | 1/2017 | Wagner et al. |
| 2017/0037432 A1 | 2/2017 | Donohoue et al. |
| 2017/0044520 A1 | 2/2017 | Liu et al. |
| 2017/0044592 A1 | 2/2017 | Peter et al. |
| 2017/0053729 A1 | 2/2017 | Kotani et al. |
| 2017/0058271 A1 | 3/2017 | Joung et al. |
| 2017/0058272 A1 | 3/2017 | Carter et al. |
| 2017/0058298 A1 | 3/2017 | Kennedy et al. |
| 2017/0073663 A1 | 3/2017 | Wang et al. |
| 2017/0073670 A1 | 3/2017 | Nishida et al. |
| 2017/0087224 A1 | 3/2017 | Quake |
| 2017/0087225 A1 | 3/2017 | Quake |
| 2017/0088587 A1 | 3/2017 | Quake |
| 2017/0088828 A1 | 3/2017 | Quake |
| 2017/0107536 A1 | 4/2017 | Zhang et al. |
| 2017/0107560 A1 | 4/2017 | Peter et al. |
| 2017/0114367 A1 | 4/2017 | Hu et al. |
| 2017/0121693 A1 | 5/2017 | Liu et al. |
| 2017/0145394 A1 | 5/2017 | Yeo et al. |
| 2017/0145405 A1 | 5/2017 | Tang et al. |
| 2017/0145438 A1 | 5/2017 | Kantor |
| 2017/0152528 A1 | 6/2017 | Zhang |
| 2017/0152787 A1 | 6/2017 | Kubo et al. |
| 2017/0159033 A1 | 6/2017 | Kamtekar et al. |
| 2017/0166928 A1 | 6/2017 | Vyas et al. |
| 2017/0175104 A1 | 6/2017 | Doudna et al. |
| 2017/0175142 A1 | 6/2017 | Zhang et al. |
| 2017/0191047 A1 | 7/2017 | Terns et al. |
| 2017/0191078 A1 | 7/2017 | Zhang et al. |
| 2017/0198269 A1 | 7/2017 | Zhang et al. |
| 2017/0198277 A1 | 7/2017 | Kmiec et al. |
| 2017/0198302 A1 | 7/2017 | Feng et al. |
| 2017/0226522 A1 | 8/2017 | Hu et al. |
| 2017/0233703 A1 | 8/2017 | Xie et al. |
| 2017/0233756 A1 | 8/2017 | Begemann et al. |
| 2017/0247671 A1 | 8/2017 | Yung et al. |
| 2017/0247703 A1 | 8/2017 | Sloan et al. |
| 2017/0268022 A1 | 9/2017 | Liu et al. |
| 2017/0283797 A1 | 10/2017 | Robb et al. |
| 2017/0314016 A1 | 11/2017 | Kim et al. |
| 2017/0362635 A1 | 12/2017 | Chamberlain et al. |
| 2018/0064077 A1 | 3/2018 | Dunham et al. |
| 2018/0066258 A1 | 3/2018 | Powell |
| 2018/0068062 A1 | 3/2018 | Zhang et al. |
| 2018/0073012 A1 | 3/2018 | Liu et al. |
| 2018/0100147 A1 | 4/2018 | Yates et al. |
| 2018/0105867 A1 | 4/2018 | Xiao et al. |
| 2018/0119118 A1 | 5/2018 | Lu et al. |
| 2018/0127780 A1 | 5/2018 | Liu et al. |
| 2018/0155708 A1 | 6/2018 | Church et al. |
| 2018/0155720 A1 | 6/2018 | Donohoue et al. |
| 2018/0163213 A1 | 6/2018 | Aneja et al. |
| 2018/0170984 A1 | 6/2018 | Harris et al. |
| 2018/0179547 A1 | 6/2018 | Zhang et al. |
| 2018/0201921 A1 | 7/2018 | Malcolm |
| 2018/0230464 A1 | 8/2018 | Zhong |
| 2018/0230471 A1 | 8/2018 | Storici et al. |
| 2018/0236081 A1 | 8/2018 | Liu et al. |
| 2018/0237787 A1 | 8/2018 | Maianti et al. |
| 2018/0245066 A1 | 8/2018 | Yao et al. |
| 2018/0265864 A1 | 9/2018 | Li et al. |
| 2018/0273939 A1 | 9/2018 | Yu et al. |
| 2018/0282722 A1 | 10/2018 | Jakimo et al. |
| 2018/0305688 A1 | 10/2018 | Zhong |
| 2018/0305704 A1 | 10/2018 | Zhang |
| 2018/0312825 A1 | 11/2018 | Liu et al. |
| 2018/0312828 A1 | 11/2018 | Liu et al. |
| 2018/0312835 A1 | 11/2018 | Yao et al. |
| 2018/0327756 A1 | 11/2018 | Zhang et al. |
| 2019/0093099 A1 | 3/2019 | Liu et al. |
| 2019/0185883 A1 | 6/2019 | Liu et al. |
| 2019/0225955 A1 | 7/2019 | Liu et al. |
| 2019/0322992 A1 | 10/2019 | Liu et al. |
| 2019/0352632 A1 | 11/2019 | Liu et al. |
| 2019/0367891 A1 | 12/2019 | Liu et al. |
| 2020/0010818 A1 | 1/2020 | Liu et al. |
| 2020/0010835 A1 | 1/2020 | Maianti et al. |

FOREIGN PATENT DOCUMENTS

| | | |
|---|---|---|
| AU | 2015101792 A4 | 1/2016 |
| BR | 112015013786 A2 | 7/2017 |
| CA | 2894668 A1 | 6/2014 |
| CA | 2894681 A1 | 6/2014 |
| CA | 2894684 A1 | 6/2014 |
| CA | 2 852 593 A1 | 11/2015 |
| CN | 1069962 A | 3/1993 |
| CN | 103224947 A | 7/2013 |
| CN | 103233028 A | 8/2013 |
| CN | 103388006 A | 11/2013 |
| CN | 103614415 A | 3/2014 |
| CN | 103642836 A | 3/2014 |
| CN | 103668472 A | 3/2014 |
| CN | 103820441 A | 5/2014 |
| CN | 103820454 A | 5/2014 |
| CN | 103911376 A | 7/2014 |
| CN | 103923911 A | 7/2014 |
| CN | 103981211 A | 8/2014 |
| CN | 103981212 A | 8/2014 |
| CN | 104004778 A | 8/2014 |
| CN | 104004782 A | 8/2014 |
| CN | 104017821 A | 9/2014 |
| CN | 104109687 A | 10/2014 |
| CN | 104178461 A | 12/2014 |
| CN | 104342457 A | 2/2015 |
| CN | 104404036 A | 3/2015 |
| CN | 104450774 A | 3/2015 |
| CN | 104480144 A | 4/2015 |
| CN | 104498493 A | 4/2015 |
| CN | 104504304 A | 4/2015 |
| CN | 104531704 A | 4/2015 |
| CN | 104531705 A | 4/2015 |
| CN | 104560864 A | 4/2015 |
| CN | 104561095 A | 4/2015 |
| CN | 104593418 A | 5/2015 |

(56) References Cited

FOREIGN PATENT DOCUMENTS

| | | |
|---|---|---|
| CN | 104593422 A | 5/2015 |
| CN | 104611370 A | 5/2015 |
| CN | 104651392 A | 5/2015 |
| CN | 104651398 A | 5/2015 |
| CN | 104651399 A | 5/2015 |
| CN | 104651401 A | 5/2015 |
| CN | 104673816 A | 6/2015 |
| CN | 104725626 A | 6/2015 |
| CN | 104726449 A | 6/2015 |
| CN | 104726494 A | 6/2015 |
| CN | 104745626 A | 7/2015 |
| CN | 104762321 A | 7/2015 |
| CN | 104805078 A | 7/2015 |
| CN | 104805099 A | 7/2015 |
| CN | 104805118 A | 7/2015 |
| CN | 104846010 A | 8/2015 |
| CN | 104894068 A | 9/2015 |
| CN | 104894075 A | 9/2015 |
| CN | 104928321 A | 9/2015 |
| CN | 105039339 A | 11/2015 |
| CN | 105039399 A | 11/2015 |
| CN | 105063061 A | 11/2015 |
| CN | 105087620 A | 11/2015 |
| CN | 105112422 A | 12/2015 |
| CN | 105112445 A | 12/2015 |
| CN | 105112519 A | 12/2015 |
| CN | 105121648 A | 12/2015 |
| CN | 105132427 A | 12/2015 |
| CN | 105132451 A | 12/2015 |
| CN | 105177038 A | 12/2015 |
| CN | 105177126 A | 12/2015 |
| CN | 105210981 A | 1/2016 |
| CN | 105219799 A | 1/2016 |
| CN | 105238806 A | 1/2016 |
| CN | 105255937 A | 1/2016 |
| CN | 105274144 A | 1/2016 |
| CN | 105296518 A | 2/2016 |
| CN | 105296537 A | 2/2016 |
| CN | 105316324 A | 2/2016 |
| CN | 105316327 A | 2/2016 |
| CN | 105316337 A | 2/2016 |
| CN | 105331607 A | 2/2016 |
| CN | 105331608 A | 2/2016 |
| CN | 105331609 A | 2/2016 |
| CN | 105331627 A | 2/2016 |
| CN | 105400773 A | 3/2016 |
| CN | 105400779 A | 3/2016 |
| CN | 105400810 A | 3/2016 |
| CN | 105441451 A | 3/2016 |
| CN | 105462968 A | 4/2016 |
| CN | 105463003 A | 4/2016 |
| CN | 105463027 A | 4/2016 |
| CN | 105492608 A | 4/2016 |
| CN | 105492609 A | 4/2016 |
| CN | 105505976 A | 4/2016 |
| CN | 105505979 A | 4/2016 |
| CN | 105518134 A | 4/2016 |
| CN | 105518135 A | 4/2016 |
| CN | 105518137 A | 4/2016 |
| CN | 105518138 A | 4/2016 |
| CN | 105518139 A | 4/2016 |
| CN | 105518140 A | 4/2016 |
| CN | 105543228 A | 5/2016 |
| CN | 105543266 A | 5/2016 |
| CN | 105543270 A | 5/2016 |
| CN | 105567688 A | 5/2016 |
| CN | 105567689 A | 5/2016 |
| CN | 105567734 A | 5/2016 |
| CN | 105567735 A | 5/2016 |
| CN | 105567738 A | 5/2016 |
| CN | 105593367 A | 5/2016 |
| CN | 105594664 A | 5/2016 |
| CN | 105602987 A | 5/2016 |
| CN | 105624146 A | 6/2016 |
| CN | 105624187 A | 6/2016 |
| CN | 105646719 A | 6/2016 |
| CN | 105647922 A | 6/2016 |
| CN | 105647962 A | 6/2016 |
| CN | 105647968 A | 6/2016 |
| CN | 105647969 A | 6/2016 |
| CN | 105671070 A | 6/2016 |
| CN | 105671083 A | 6/2016 |
| CN | 105695485 A | 6/2016 |
| CN | 105779448 A | 7/2016 |
| CN | 105779449 A | 7/2016 |
| CN | 105802980 A | 7/2016 |
| CN | 105821039 A | 8/2016 |
| CN | 105821040 A | 8/2016 |
| CN | 105821049 A | 8/2016 |
| CN | 105821072 A | 8/2016 |
| CN | 105821075 A | 8/2016 |
| CN | 105821116 A | 8/2016 |
| CN | 105838733 A | 8/2016 |
| CN | 105861547 A | 8/2016 |
| CN | 105861552 A | 8/2016 |
| CN | 105861554 A | 8/2016 |
| CN | 105886498 A | 8/2016 |
| CN | 105886534 A | 8/2016 |
| CN | 105886616 A | 8/2016 |
| CN | 105907758 A | 8/2016 |
| CN | 105907785 A | 8/2016 |
| CN | 105925608 A | 9/2016 |
| CN | 105950560 A | 9/2016 |
| CN | 105950626 A | 9/2016 |
| CN | 105950633 A | 9/2016 |
| CN | 105950639 A | 9/2016 |
| CN | 105985985 A | 10/2016 |
| CN | 106011104 A | 10/2016 |
| CN | 106011150 A | 10/2016 |
| CN | 106011167 A | 10/2016 |
| CN | 106011171 A | 10/2016 |
| CN | 106032540 A | 10/2016 |
| CN | 106047803 A | 10/2016 |
| CN | 106047877 A | 10/2016 |
| CN | 106047930 A | 10/2016 |
| CN | 106086008 A | 11/2016 |
| CN | 106086028 A | 11/2016 |
| CN | 106086061 A | 11/2016 |
| CN | 106086062 A | 11/2016 |
| CN | 106109417 A | 11/2016 |
| CN | 106119275 A | 11/2016 |
| CN | 106119283 A | 11/2016 |
| CN | 106148286 A | 11/2016 |
| CN | 106148370 A | 11/2016 |
| CN | 106148416 A | 11/2016 |
| CN | 106167525 A | 11/2016 |
| CN | 106167808 A | 11/2016 |
| CN | 106167810 A | 11/2016 |
| CN | 106167821 A | 11/2016 |
| CN | 106172238 A | 12/2016 |
| CN | 106190903 A | 12/2016 |
| CN | 106191057 A | 12/2016 |
| CN | 106191061 A | 12/2016 |
| CN | 106191062 A | 12/2016 |
| CN | 106191064 A | 12/2016 |
| CN | 106191071 A | 12/2016 |
| CN | 106191099 A | 12/2016 |
| CN | 106191107 A | 12/2016 |
| CN | 106191113 A | 12/2016 |
| CN | 106191114 A | 12/2016 |
| CN | 106191116 A | 12/2016 |
| CN | 106191124 A | 12/2016 |
| CN | 106222177 A | 12/2016 |
| CN | 106222193 A | 12/2016 |
| CN | 106222203 A | 12/2016 |
| CN | 106244555 A | 12/2016 |
| CN | 106244591 A | 12/2016 |
| CN | 106244609 A | 12/2016 |
| CN | 106282241 A | 1/2017 |
| CN | 106318934 A | 1/2017 |
| CN | 106318973 A | 1/2017 |
| CN | 106350540 A | 1/2017 |
| CN | 106367435 A | 2/2017 |
| CN | 106399306 A | 2/2017 |

(56) References Cited

FOREIGN PATENT DOCUMENTS

| | | |
|---|---|---|
| CN | 106399311 A | 2/2017 |
| CN | 106399360 A | 2/2017 |
| CN | 106399367 A | 2/2017 |
| CN | 106399375 A | 2/2017 |
| CN | 106399377 A | 2/2017 |
| CN | 106434651 A | 2/2017 |
| CN | 106434663 A | 2/2017 |
| CN | 106434688 A | 2/2017 |
| CN | 106434737 A | 2/2017 |
| CN | 106434748 A | 2/2017 |
| CN | 106434752 A | 2/2017 |
| CN | 106434782 A | 2/2017 |
| CN | 106446600 A | 2/2017 |
| CN | 106479985 A | 3/2017 |
| CN | 106480027 A | 3/2017 |
| CN | 106480036 A | 3/2017 |
| CN | 106480067 A | 3/2017 |
| CN | 106480080 A | 3/2017 |
| CN | 106480083 A | 3/2017 |
| CN | 106480097 A | 3/2017 |
| CN | 106544351 A | 3/2017 |
| CN | 106544353 A | 3/2017 |
| CN | 106544357 A | 3/2017 |
| CN | 106554969 A | 4/2017 |
| CN | 106566838 A | 4/2017 |
| CN | 106701763 A | 5/2017 |
| CN | 106701808 A | 5/2017 |
| CN | 106701818 A | 5/2017 |
| CN | 106701823 A | 5/2017 |
| CN | 106701830 A | 5/2017 |
| CN | 106754912 A | 5/2017 |
| CN | 106755026 A | 5/2017 |
| CN | 106755077 A | 5/2017 |
| CN | 106755088 A | 5/2017 |
| CN | 106755091 A | 5/2017 |
| CN | 106755097 A | 5/2017 |
| CN | 106755424 A | 5/2017 |
| CN | 106801056 A | 6/2017 |
| CN | 106834323 A | 6/2017 |
| CN | 106834341 A | 6/2017 |
| CN | 106834347 A | 6/2017 |
| CN | 106845151 A | 6/2017 |
| CN | 106868008 A | 6/2017 |
| CN | 106868031 A | 6/2017 |
| CN | 106906240 A | 6/2017 |
| CN | 106906242 A | 6/2017 |
| CN | 106916820 A | 7/2017 |
| CN | 106916852 A | 7/2017 |
| CN | 106939303 A | 7/2017 |
| CN | 106947750 A | 7/2017 |
| CN | 106947780 A | 7/2017 |
| CN | 106957830 A | 7/2017 |
| CN | 106957831 A | 7/2017 |
| CN | 106957844 A | 7/2017 |
| CN | 106957855 A | 7/2017 |
| CN | 106957858 A | 7/2017 |
| CN | 106967697 A | 7/2017 |
| CN | 106967726 A | 7/2017 |
| CN | 106978428 A | 7/2017 |
| CN | 106987570 A | 7/2017 |
| CN | 106987757 A | 7/2017 |
| CN | 107012164 A | 8/2017 |
| CN | 107012174 A | 8/2017 |
| CN | 107012213 A | 8/2017 |
| CN | 107012250 A | 8/2017 |
| CN | 107022562 A | 8/2017 |
| CN | 107034188 A | 8/2017 |
| CN | 107034218 A | 8/2017 |
| CN | 107034229 A | 8/2017 |
| CN | 107043775 A | 8/2017 |
| CN | 107043779 A | 8/2017 |
| CN | 107043787 A | 8/2017 |
| CN | 107058320 A | 8/2017 |
| CN | 107058328 A | 8/2017 |
| CN | 107058358 A | 8/2017 |
| CN | 107058372 A | 8/2017 |
| CN | 107083392 A | 8/2017 |
| CN | 107099533 A | 8/2017 |
| CN | 107099850 A | 8/2017 |
| CN | 107119053 A | 9/2017 |
| CN | 107119071 A | 9/2017 |
| CN | 107129999 A | 9/2017 |
| CN | 107130000 A | 9/2017 |
| CN | 107142272 A | 9/2017 |
| CN | 107142282 A | 9/2017 |
| CN | 107177591 A | 9/2017 |
| CN | 107177595 A | 9/2017 |
| CN | 107177631 A | 9/2017 |
| CN | 107190006 A | 9/2017 |
| CN | 107190008 A | 9/2017 |
| CN | 107217042 A | 9/2017 |
| CN | 107217075 A | 9/2017 |
| CN | 107227307 A | 10/2017 |
| CN | 107227352 A | 10/2017 |
| CN | 107236737 A | 10/2017 |
| CN | 107236739 A | 10/2017 |
| CN | 107236741 A | 10/2017 |
| CN | 107245502 A | 10/2017 |
| CN | 107254485 A | 10/2017 |
| CN | 107266541 A | 10/2017 |
| CN | 107267515 A | 10/2017 |
| CN | 107287245 A | 10/2017 |
| CN | 107298701 A | 10/2017 |
| CN | 107299114 A | 10/2017 |
| CN | 107304435 A | 10/2017 |
| CN | 107312785 A | 11/2017 |
| CN | 107312793 A | 11/2017 |
| CN | 107312795 A | 11/2017 |
| CN | 107312798 A | 11/2017 |
| CN | 107326042 A | 11/2017 |
| CN | 107326046 A | 11/2017 |
| CN | 107354156 A | 11/2017 |
| CN | 107354173 A | 11/2017 |
| CN | 107356793 A | 11/2017 |
| CN | 107362372 A | 11/2017 |
| CN | 107365786 A | 11/2017 |
| CN | 107365804 A | 11/2017 |
| CN | 107384894 A | 11/2017 |
| CN | 107384922 A | 11/2017 |
| CN | 107384926 A | 11/2017 |
| CN | 107400677 A | 11/2017 |
| CN | 107418974 A | 12/2017 |
| CN | 107435051 A | 12/2017 |
| CN | 107435069 A | 12/2017 |
| CN | 107446922 A | 12/2017 |
| CN | 107446923 A | 12/2017 |
| CN | 107446924 A | 12/2017 |
| CN | 107446932 A | 12/2017 |
| CN | 107446951 A | 12/2017 |
| CN | 107446954 A | 12/2017 |
| CN | 107460196 A | 12/2017 |
| CN | 107474129 A | 12/2017 |
| CN | 107475300 A | 12/2017 |
| CN | 107488649 A | 12/2017 |
| CN | 107502608 A | 12/2017 |
| CN | 107502618 A | 12/2017 |
| CN | 107513531 A | 12/2017 |
| CN | 107519492 A | 12/2017 |
| CN | 107523567 A | 12/2017 |
| CN | 107523583 A | 12/2017 |
| CN | 107541525 A | 1/2018 |
| CN | 107557373 A | 1/2018 |
| CN | 107557378 A | 1/2018 |
| CN | 107557381 A | 1/2018 |
| CN | 107557390 A | 1/2018 |
| CN | 107557393 A | 1/2018 |
| CN | 107557394 A | 1/2018 |
| CN | 107557455 A | 1/2018 |
| CN | 107574179 | 1/2018 |
| CN | 107586777 | 1/2018 |
| CN | 107586779 | 1/2018 |
| CN | 107604003 | 1/2018 |
| CN | 107619837 A | 1/2018 |
| CN | 107630006 A | 1/2018 |

(56) References Cited

FOREIGN PATENT DOCUMENTS

| | | |
|---|---|---|
| CN | 107630041 A | 1/2018 |
| CN | 107630042 A | 1/2018 |
| CN | 107630043 A | 1/2018 |
| CN | 107641631 A | 1/2018 |
| CN | 107653256 A | 2/2018 |
| CN | 107686848 A | 2/2018 |
| CN | 206970581 | 2/2018 |
| CN | 107760652 A | 3/2018 |
| CN | 107760663 A | 3/2018 |
| CN | 107760684 A | 3/2018 |
| CN | 107760715 A | 3/2018 |
| CN | 107784200 A | 3/2018 |
| CN | 107794272 A | 3/2018 |
| CN | 107794276 A | 3/2018 |
| CN | 107815463 A | 3/2018 |
| CN | 107828738 A | 3/2018 |
| CN | 107828794 A | 3/2018 |
| CN | 107828826 A | 3/2018 |
| CN | 107828874 A | 3/2018 |
| CN | 107858346 A | 3/2018 |
| CN | 107858373 A | 3/2018 |
| CN | 107880132 A | 4/2018 |
| CN | 107881184 A | 4/2018 |
| CN | 107893074 A | 4/2018 |
| CN | 107893075 A | 4/2018 |
| CN | 107893076 A | 4/2018 |
| CN | 107893080 A | 4/2018 |
| CN | 107893086 A | 4/2018 |
| CN | 107904261 A | 4/2018 |
| CN | 107937427 A | 4/2018 |
| CN | 107937432 A | 4/2018 |
| CN | 107937501 A | 4/2018 |
| CN | 107974466 A | 5/2018 |
| CN | 107988229 A | 5/2018 |
| CN | 107988246 A | 5/2018 |
| CN | 107988256 A | 5/2018 |
| CN | 107988268 A | 5/2018 |
| CN | 108018316 A | 5/2018 |
| CN | 108034656 A | 5/2018 |
| CN | 108048466 A | 5/2018 |
| CN | 108102940 A | 6/2018 |
| CN | 108103092 A | 6/2018 |
| CN | 108103098 A | 6/2018 |
| CN | 108103586 A | 6/2018 |
| CN | 108148835 A | 6/2018 |
| CN | 108148837 A | 6/2018 |
| CN | 108148873 A | 6/2018 |
| CN | 108192956 A | 6/2018 |
| CN | 108251423 A | 7/2018 |
| CN | 108251451 A | 7/2018 |
| CN | 108251452 A | 7/2018 |
| CN | 108342480 A | 7/2018 |
| CN | 108359691 A | 8/2018 |
| CN | 108359712 A | 8/2018 |
| CN | 108384784 A | 8/2018 |
| CN | 108396027 A | 8/2018 |
| CN | 108410877 A | 8/2018 |
| CN | 108410906 A | 8/2018 |
| CN | 108410907 A | 8/2018 |
| CN | 108410911 A | 8/2018 |
| CN | 108424931 A | 8/2018 |
| CN | 108441519 A | 8/2018 |
| CN | 108441520 A | 8/2018 |
| CN | 108486108 A | 9/2018 |
| CN | 108486111 A | 9/2018 |
| CN | 108486145 A | 9/2018 |
| CN | 108486146 A | 9/2018 |
| CN | 108486154 A | 9/2018 |
| CN | 108486159 A | 9/2018 |
| CN | 108486234 A | 9/2018 |
| CN | 108504657 A | 9/2018 |
| CN | 108504685 A | 9/2018 |
| CN | 108504693 A | 9/2018 |
| CN | 108546712 A | 9/2018 |
| CN | 108546717 A | 9/2018 |
| CN | 108546718 A | 9/2018 |
| CN | 108559730 A | 9/2018 |
| CN | 108559732 A | 9/2018 |
| CN | 108559745 A | 9/2018 |
| CN | 108559760 A | 9/2018 |
| CN | 108570479 A | 9/2018 |
| CN | 108588071 A | 9/2018 |
| CN | 108588123 A | 9/2018 |
| CN | 108588128 A | 9/2018 |
| CN | 108588182 A | 9/2018 |
| CN | 108610399 A | 10/2018 |
| CN | 108611364 A | 10/2018 |
| CN | 108624622 A | 10/2018 |
| CN | 108642053 A | 10/2018 |
| CN | 108642055 A | 10/2018 |
| CN | 108642077 A | 10/2018 |
| CN | 108642078 A | 10/2018 |
| CN | 108642090 A | 10/2018 |
| CN | 108690844 A | 10/2018 |
| CN | 108707604 A | 10/2018 |
| CN | 108707620 A | 10/2018 |
| CN | 108707621 A | 10/2018 |
| CN | 108707628 A | 10/2018 |
| CN | 108707629 A | 10/2018 |
| CN | 108715850 A | 10/2018 |
| CN | 108728476 A | 11/2018 |
| CN | 108728486 A | 11/2018 |
| CN | 108753772 A | 11/2018 |
| CN | 108753783 A | 11/2018 |
| CN | 108753813 A | 11/2018 |
| CN | 108753817 A | 11/2018 |
| CN | 108753832 A | 11/2018 |
| CN | 108753835 A | 11/2018 |
| CN | 108753836 A | 11/2018 |
| CN | 108795902 A | 11/2018 |
| CN | 108822217 A | 11/2018 |
| CN | 108823248 A | 11/2018 |
| CN | 108823249 A | 11/2018 |
| CN | 108823291 A | 11/2018 |
| CN | 108841845 A | 11/2018 |
| CN | 108853133 A | 11/2018 |
| CN | 108866093 A | 11/2018 |
| CN | 108893529 A | 11/2018 |
| CN | 108913664 A | 11/2018 |
| CN | 108913691 A | 11/2018 |
| CN | 108913714 A | 11/2018 |
| CN | 108913717 A | 11/2018 |
| EP | 2 604 255 A1 | 6/2013 |
| EP | 2840140 A1 | 2/2015 |
| EP | 2 966 170 A1 | 1/2016 |
| EP | 3009511 A2 | 4/2016 |
| EP | 3031921 A1 | 6/2016 |
| EP | 3045537 A1 | 7/2016 |
| EP | 3 115 457 A1 | 1/2017 |
| EP | 3144390 A1 | 3/2017 |
| EP | 3199632 A1 | 8/2017 |
| EP | 3216867 A1 | 9/2017 |
| EP | 3252160 A1 | 12/2017 |
| GB | 2 528 177 A | 1/2016 |
| GB | 2 531 454 A | 4/2016 |
| GB | 2542653 A | 3/2017 |
| HK | 1208045 A1 | 2/2016 |
| JP | 2007-501626 A | 2/2007 |
| JP | 2008-515405 A | 5/2008 |
| JP | 2010-539929 A | 12/2010 |
| JP | 2011-081011 A | 4/2011 |
| JP | 2011-523353 A | 8/2011 |
| JP | 2012-525146 A | 10/2012 |
| JP | 2012-531909 A | 12/2012 |
| KR | 101584933 B1 | 1/2016 |
| KR | 20160133380 A | 11/2016 |
| KR | 20170037025 A | 4/2017 |
| KR | 20170037028 A | 4/2017 |
| KR | 101748575 B1 | 6/2017 |
| KR | 2018-0022465 A | 3/2018 |
| RU | 2016104674 A | 8/2017 |
| RU | 2634395 C1 | 10/2017 |
| RU | 2652899 C1 | 5/2018 |
| RU | 2015128057 A | 3/2019 |

(56) References Cited

FOREIGN PATENT DOCUMENTS

| | | |
|---|---|---|
| RU | 2015128098 A | 3/2019 |
| RU | 2687451 C1 | 5/2019 |
| RU | 2019112514 A | 6/2019 |
| RU | 2019127300 A | 9/2019 |
| RU | 2701850 C2 | 10/2019 |
| TW | I608100 B | 12/2017 |
| TW | 2018-29773 A | 8/2018 |
| WO | WO 2001/036452 A2 | 5/2001 |
| WO | WO-2001/38547 A2 | 5/2001 |
| WO | WO-2002/059296 A2 | 8/2002 |
| WO | WO-2002/068676 A2 | 9/2002 |
| WO | WO-2002/103028 A2 | 12/2002 |
| WO | WO-2004/007684 A2 | 1/2004 |
| WO | WO-2005/014791 A2 | 2/2005 |
| WO | WO 2005/019415 A2 | 3/2005 |
| WO | WO-2006/002547 A1 | 1/2006 |
| WO | WO-2006/042112 A2 | 4/2006 |
| WO | WO-2007/025097 A2 | 3/2007 |
| WO | WO-2007/136815 A2 | 11/2007 |
| WO | WO-2007/143574 A1 | 12/2007 |
| WO | WO-2008/108989 A2 | 9/2008 |
| WO | WO-2009/134808 A2 | 11/2009 |
| WO | WO-2010/011961 A2 | 1/2010 |
| WO | WO-2010/054108 A2 | 5/2010 |
| WO | WO-2010/054154 A2 | 5/2010 |
| WO | WO-2010/068289 A2 | 6/2010 |
| WO | WO-2010/075424 A2 | 7/2010 |
| WO | WO-2010/102257 A2 | 9/2010 |
| WO | WO-2010/129019 A2 | 11/2010 |
| WO | WO-2010/129023 A2 | 11/2010 |
| WO | WO-2010/132092 A2 | 11/2010 |
| WO | WO-2010/144150 A2 | 12/2010 |
| WO | WO-2011/002503 A1 | 1/2011 |
| WO | WO-2011/017293 A2 | 2/2011 |
| WO | WO-2011/053868 A1 | 5/2011 |
| WO | WO-2011/053982 A2 | 5/2011 |
| WO | WO-2011/075627 A1 | 6/2011 |
| WO | WO-2011/091311 A2 | 7/2011 |
| WO | WO-2011/109031 A1 | 9/2011 |
| WO | WO-2011/143124 A2 | 11/2011 |
| WO | WO-2012/054726 A1 | 4/2012 |
| WO | WO-2012/065043 A2 | 5/2012 |
| WO | WO-2012/125445 A2 | 9/2012 |
| WO | WO-2012/138927 A2 | 10/2012 |
| WO | WO 2012/149470 A1 | 11/2012 |
| WO | WO-2012/158985 A2 | 11/2012 |
| WO | WO-2012/158986 A2 | 11/2012 |
| WO | WO-2012/164565 A1 | 12/2012 |
| WO | WO-2013/012674 A1 | 1/2013 |
| WO | WO-2013/013105 A2 | 1/2013 |
| WO | WO 2013/047844 A1 | 4/2013 |
| WO | WO-2013/066438 A2 | 5/2013 |
| WO | WO-2013/098244 A1 | 7/2013 |
| WO | WO-2013/119602 A1 | 8/2013 |
| WO | WO-2013/126794 A1 | 8/2013 |
| WO | WO-2013/130824 A1 | 9/2013 |
| WO | WO-2013/141680 A1 | 9/2013 |
| WO | WO-2013/142578 A1 | 9/2013 |
| WO | WO 2013/152359 A1 | 10/2013 |
| WO | WO-2013/160230 A1 | 10/2013 |
| WO | WO-2013/166315 A1 | 11/2013 |
| WO | WO-2013/169398 A2 | 11/2013 |
| WO | WO-2013/169802 A1 | 11/2013 |
| WO | WO-2013/176772 A1 | 11/2013 |
| WO | WO-2013/176915 A1 | 11/2013 |
| WO | WO-2013/176916 A1 | 11/2013 |
| WO | WO-2013/181440 A1 | 12/2013 |
| WO | WO-2013/186754 A2 | 12/2013 |
| WO | WO-2013/188037 A2 | 12/2013 |
| WO | WO-2013/188522 A2 | 12/2013 |
| WO | WO-2013/188638 A2 | 12/2013 |
| WO | WO-2013/192278 A1 | 12/2013 |
| WO | WO-2013/142378 A9 | 1/2014 |
| WO | WO-2014/005042 A2 | 1/2014 |
| WO | WO-2014/011237 A1 | 1/2014 |
| WO | WO-2014/011901 A2 | 1/2014 |
| WO | WO-2014/018423 A2 | 1/2014 |
| WO | WO-2014/020608 A1 | 2/2014 |
| WO | WO-2014/022120 A1 | 2/2014 |
| WO | WO-2014/022702 A2 | 2/2014 |
| WO | WO-2014/036219 A2 | 3/2014 |
| WO | WO-2014/039513 A2 | 3/2014 |
| WO | WO-2014/039523 A1 | 3/2014 |
| WO | WO-2014/039684 A1 | 3/2014 |
| WO | WO-2014/039692 A2 | 3/2014 |
| WO | WO-2014/039702 A2 | 3/2014 |
| WO | WO-2014/039872 A1 | 3/2014 |
| WO | WO-2014/039970 A1 | 3/2014 |
| WO | WO-2014/041327 A1 | 3/2014 |
| WO | WO-2014/043143 A1 | 3/2014 |
| WO | WO-2014/047103 A2 | 3/2014 |
| WO | WO-2014/059173 A2 | 4/2014 |
| WO | WO-2014/059255 A1 | 4/2014 |
| WO | WO-2014/065596 A1 | 5/2014 |
| WO | WO-2014/066505 A1 | 5/2014 |
| WO | WO-2014/068346 A2 | 5/2014 |
| WO | WO-2014/070887 A1 | 5/2014 |
| WO | WO-2014/071006 A1 | 5/2014 |
| WO | WO-2014/071219 A1 | 5/2014 |
| WO | WO-2014/071235 A1 | 5/2014 |
| WO | WO-2014/072941 A1 | 5/2014 |
| WO | WO-2014/081729 A1 | 5/2014 |
| WO | WO-2014/081730 A1 | 5/2014 |
| WO | WO-2014/081855 A1 | 5/2014 |
| WO | WO-2014/082644 A1 | 6/2014 |
| WO | WO-2014/085261 A1 | 6/2014 |
| WO | WO-2014/085593 A1 | 6/2014 |
| WO | WO-2014/085830 A2 | 6/2014 |
| WO | WO-2014/089212 A1 | 6/2014 |
| WO | WO-2014/089290 A1 | 6/2014 |
| WO | WO-2014/089348 A1 | 6/2014 |
| WO | WO-2014/089513 A1 | 6/2014 |
| WO | WO-2014/089533 A2 | 6/2014 |
| WO | WO-2014/089541 A2 | 6/2014 |
| WO | WO-2014/093479 A1 | 6/2014 |
| WO | WO-2014/093595 A1 | 6/2014 |
| WO | WO-2014/093622 A2 | 6/2014 |
| WO | WO-2014/093635 A1 | 6/2014 |
| WO | WO-2014/093655 A2 | 6/2014 |
| WO | WO-2014/093661 A2 | 6/2014 |
| WO | WO-2014/093694 A1 | 6/2014 |
| WO | WO-2014/093701 A1 | 6/2014 |
| WO | WO-2014/093709 A1 | 6/2014 |
| WO | WO-2014/093712 A1 | 6/2014 |
| WO | WO-2014/093718 A1 | 6/2014 |
| WO | WO-2014/093736 A1 | 6/2014 |
| WO | WO-2014/093768 A1 | 6/2014 |
| WO | WO-2014/093852 A1 | 6/2014 |
| WO | WO-2014/096972 A2 | 6/2014 |
| WO | WO-2014/099744 A1 | 6/2014 |
| WO | WO-2014/099750 A2 | 6/2014 |
| WO | WO-2014/104878 A1 | 7/2014 |
| WO | WO-2014/110006 A1 | 7/2014 |
| WO | WO-2014/110552 A1 | 7/2014 |
| WO | WO-2014/113493 A1 | 7/2014 |
| WO | WO-2014/123967 A2 | 8/2014 |
| WO | WO-2014/124226 A1 | 8/2014 |
| WO | WO-2014/125668 A1 | 8/2014 |
| WO | WO-2014/127287 A1 | 8/2014 |
| WO | WO-2014/128324 A1 | 8/2014 |
| WO | WO-2014/128659 A1 | 8/2014 |
| WO | WO-2014/130706 A1 | 8/2014 |
| WO | WO-2014/130955 A1 | 8/2014 |
| WO | WO-2014/131833 A1 | 9/2014 |
| WO | WO-2014/138379 A1 | 9/2014 |
| WO | WO-2014/143381 A1 | 9/2014 |
| WO | WO-2014/144094 A1 | 9/2014 |
| WO | WO-2014/144155 A1 | 9/2014 |
| WO | WO-2014/144288 A1 | 9/2014 |
| WO | WO-2014/144592 A2 | 9/2014 |
| WO | WO-2014/144761 A2 | 9/2014 |
| WO | WO-2014/144951 A1 | 9/2014 |
| WO | WO-2014/145599 A2 | 9/2014 |
| WO | WO-2014/145736 A2 | 9/2014 |

(56) References Cited

FOREIGN PATENT DOCUMENTS

| | | |
|---|---|---|
| WO | WO-2014/150624 A1 | 9/2014 |
| WO | WO-2014/152432 A2 | 9/2014 |
| WO | WO-2014/153118 A1 | 9/2014 |
| WO | WO-2014/153470 A2 | 9/2014 |
| WO | WO-2014/161821 A1 | 10/2014 |
| WO | WO-2014/164466 A1 | 10/2014 |
| WO | WO-2014/165177 A1 | 10/2014 |
| WO | WO-2014/165349 A1 | 10/2014 |
| WO | WO-2014/165612 A2 | 10/2014 |
| WO | WO-2014/165707 A2 | 10/2014 |
| WO | WO-2014/165825 A2 | 10/2014 |
| WO | WO-2014/172458 A1 | 10/2014 |
| WO | WO-2014/172470 A2 | 10/2014 |
| WO | WO-2014/172489 A2 | 10/2014 |
| WO | WO-2014/173955 A1 | 10/2014 |
| WO | WO-2014/182700 A1 | 11/2014 |
| WO | WO-2014/183071 A2 | 11/2014 |
| WO | WO-2014/184143 A1 | 11/2014 |
| WO | WO-2014/184741 A1 | 11/2014 |
| WO | WO-2014/184744 A1 | 11/2014 |
| WO | WO-2014/186585 A2 | 11/2014 |
| WO | WO-2014/186686 A2 | 11/2014 |
| WO | WO-2014/190181 A1 | 11/2014 |
| WO | WO-2014/191128 A1 | 12/2014 |
| WO | WO-2014/191518 A1 | 12/2014 |
| WO | WO-2014/191521 A2 | 12/2014 |
| WO | WO-2014/191525 A1 | 12/2014 |
| WO | WO-2014/191527 A1 | 12/2014 |
| WO | WO-2014/193583 A2 | 12/2014 |
| WO | WO-2014/194190 A1 | 12/2014 |
| WO | WO-2014/197568 A2 | 12/2014 |
| WO | WO-2014/199358 A1 | 12/2014 |
| WO | WO-2014/200659 A1 | 12/2014 |
| WO | WO-2014/201015 A2 | 12/2014 |
| WO | WO-2014/204578 A1 | 12/2014 |
| WO | WO-2014/204723 A1 | 12/2014 |
| WO | WO-2014/204724 A1 | 12/2014 |
| WO | WO-2014/204725 A1 | 12/2014 |
| WO | WO-2014/204726 A1 | 12/2014 |
| WO | WO-2014/204727 A1 | 12/2014 |
| WO | WO-2014/204728 A1 | 12/2014 |
| WO | WO-2014/204729 A1 | 12/2014 |
| WO | WO-2014/205192 A2 | 12/2014 |
| WO | WO-2014/207043 A1 | 12/2014 |
| WO | WO-2014197748 A2 | 12/2014 |
| WO | WO-2015/002780 A1 | 1/2015 |
| WO | WO-2015/004241 A2 | 1/2015 |
| WO | WO-2015/006290 A1 | 1/2015 |
| WO | WO-2015/006294 A2 | 1/2015 |
| WO | WO-2015/006437 A1 | 1/2015 |
| WO | WO-2015/006498 A2 | 1/2015 |
| WO | WO-2015/007194 A1 | 1/2015 |
| WO | WO-2015/010114 A1 | 1/2015 |
| WO | WO-2015/011483 A1 | 1/2015 |
| WO | WO-2015/013583 A2 | 1/2015 |
| WO | WO-2015006747 A2 | 1/2015 |
| WO | WO-2015/017866 A1 | 2/2015 |
| WO | WO-2015/018503 A1 | 2/2015 |
| WO | WO-2015/021353 A1 | 2/2015 |
| WO | WO-2015/021426 A1 | 2/2015 |
| WO | WO-2015/021990 A1 | 2/2015 |
| WO | WO-2015/024017 A2 | 2/2015 |
| WO | WO-2015/024986 A1 | 2/2015 |
| WO | WO-2015/026883 A1 | 2/2015 |
| WO | WO-2015/026885 A1 | 2/2015 |
| WO | WO-2015/026886 A1 | 2/2015 |
| WO | WO-2015/026887 A1 | 2/2015 |
| WO | WO-2015/027134 A1 | 2/2015 |
| WO | WO-2015/028969 A2 | 3/2015 |
| WO | WO-2015/030881 A1 | 3/2015 |
| WO | WO-2015/031619 A1 | 3/2015 |
| WO | WO-2015/031775 A1 | 3/2015 |
| WO | WO-2015/032494 A2 | 3/2015 |
| WO | WO-2015/033293 A1 | 3/2015 |
| WO | WO-2015/034872 A2 | 3/2015 |
| WO | WO-2015/034885 A1 | 3/2015 |
| WO | WO-2015/035136 A2 | 3/2015 |
| WO | WO-2015/035139 A2 | 3/2015 |
| WO | WO-2015/035162 A2 | 3/2015 |
| WO | WO-2015/040075 A1 | 3/2015 |
| WO | WO-2015/040402 A1 | 3/2015 |
| WO | WO-2015/042585 A1 | 3/2015 |
| WO | WO-2015/048577 A2 | 4/2015 |
| WO | WO-2015/048690 A1 | 4/2015 |
| WO | WO-2015/048707 A2 | 4/2015 |
| WO | WO-2015/048801 A2 | 4/2015 |
| WO | WO-2015/049897 A1 | 4/2015 |
| WO | WO-2015/051191 A1 | 4/2015 |
| WO | WO-2015/052133 A1 | 4/2015 |
| WO | WO-2015/052231 A2 | 4/2015 |
| WO | WO-2015/052335 A1 | 4/2015 |
| WO | WO-2015/053995 A1 | 4/2015 |
| WO | WO-2015/054253 A1 | 4/2015 |
| WO | WO-2015/054315 A1 | 4/2015 |
| WO | WO-2015/057671 A1 | 4/2015 |
| WO | WO-2015/057834 A1 | 4/2015 |
| WO | WO-2015/057852 A1 | 4/2015 |
| WO | WO-2015/057976 A1 | 4/2015 |
| WO | WO-2015/057980 A1 | 4/2015 |
| WO | WO-2015/059265 A1 | 4/2015 |
| WO | WO-2015/065964 A1 | 5/2015 |
| WO | WO-2015/066119 A1 | 5/2015 |
| WO | WO-2015/066634 A2 | 5/2015 |
| WO | WO-2015/066636 A2 | 5/2015 |
| WO | WO-2015/066637 A1 | 5/2015 |
| WO | WO-2015/066638 A2 | 5/2015 |
| WO | WO-2015/066643 A1 | 5/2015 |
| WO | WO-2015/069682 A2 | 5/2015 |
| WO | WO-2015/070083 A1 | 5/2015 |
| WO | WO-2015/070193 A1 | 5/2015 |
| WO | WO-2015/070212 A1 | 5/2015 |
| WO | WO-2015/071474 A2 | 5/2015 |
| WO | WO-2015/073683 A2 | 5/2015 |
| WO | WO-2015/073867 A1 | 5/2015 |
| WO | WO-2015/073990 A1 | 5/2015 |
| WO | WO-2015/075056 A1 | 5/2015 |
| WO | WO-2015/075154 A2 | 5/2015 |
| WO | WO-2015/075175 A1 | 5/2015 |
| WO | WO-2015/075195 A1 | 5/2015 |
| WO | WO-2015/075557 A2 | 5/2015 |
| WO | WO-2015/077058 A2 | 5/2015 |
| WO | WO-2015/077290 A2 | 5/2015 |
| WO | WO-2015/077318 A1 | 5/2015 |
| WO | WO-2015/079056 A1 | 6/2015 |
| WO | WO-2015/079057 A2 | 6/2015 |
| WO | WO-2015/086795 A1 | 6/2015 |
| WO | WO-2015/086798 A2 | 6/2015 |
| WO | WO-2015/088643 A1 | 6/2015 |
| WO | WO-2015/089046 A1 | 6/2015 |
| WO | WO-2015/089077 A2 | 6/2015 |
| WO | WO-2015/089277 A1 | 6/2015 |
| WO | WO-2015/089351 A1 | 6/2015 |
| WO | WO-2015/089354 A1 | 6/2015 |
| WO | WO-2015/089364 A1 | 6/2015 |
| WO | WO-2015/089406 A1 | 6/2015 |
| WO | WO-2015/089419 A2 | 6/2015 |
| WO | WO-2015/089427 A1 | 6/2015 |
| WO | WO-2015/089462 A1 | 6/2015 |
| WO | WO-2015/089465 A1 | 6/2015 |
| WO | WO-2015/089473 A1 | 6/2015 |
| WO | WO-2015/089486 A2 | 6/2015 |
| WO | WO-2015/095804 A1 | 6/2015 |
| WO | WO-2015/099850 A1 | 7/2015 |
| WO | WO-2015/100929 A1 | 7/2015 |
| WO | WO-2015/103057 A1 | 7/2015 |
| WO | WO-2015/103153 A1 | 7/2015 |
| WO | WO-2015/105928 A1 | 7/2015 |
| WO | WO-2015/108993 A1 | 7/2015 |
| WO | WO-2015/109752 A1 | 7/2015 |
| WO | WO-2015/110474 A1 | 7/2015 |
| WO | WO-2015/112790 A2 | 7/2015 |
| WO | WO-2015/112896 A2 | 7/2015 |
| WO | WO-2015/113063 A1 | 7/2015 |
| WO | WO-2015/114365 A1 | 8/2015 |

(56) References Cited

FOREIGN PATENT DOCUMENTS

| | | |
|---|---|---|
| WO | WO-2015/115903 A1 | 8/2015 |
| WO | WO-2015/116686 A1 | 8/2015 |
| WO | WO-2015/116969 A2 | 8/2015 |
| WO | WO-2015/117021 A1 | 8/2015 |
| WO | WO-2015/117041 A1 | 8/2015 |
| WO | WO-2015/117081 A2 | 8/2015 |
| WO | WO-2015/118156 A1 | 8/2015 |
| WO | WO-2015/119941 A2 | 8/2015 |
| WO | WO-2015/121454 A1 | 8/2015 |
| WO | WO-2015/122967 A1 | 8/2015 |
| WO | WO-2015/123339 A1 | 8/2015 |
| WO | WO-2015/124715 A1 | 8/2015 |
| WO | WO-2015/124718 A1 | 8/2015 |
| WO | WO-2015/126927 A2 | 8/2015 |
| WO | WO-2015/127428 A1 | 8/2015 |
| WO | WO-2015/127439 A1 | 8/2015 |
| WO | WO-2015/129686 A1 | 9/2015 |
| WO | WO-2015/131101 A1 | 9/2015 |
| WO | WO-2015/133554 A1 | 9/2015 |
| WO | WO-2015/134812 A1 | 9/2015 |
| WO | WO-2015/136001 A1 | 9/2015 |
| WO | WO-2015/138510 A1 | 9/2015 |
| WO | WO-2015/138739 A2 | 9/2015 |
| WO | WO-2015/138855 A1 | 9/2015 |
| WO | WO-2015/138870 A2 | 9/2015 |
| WO | WO-2015/139008 A1 | 9/2015 |
| WO | WO-2015/139139 A1 | 9/2015 |
| WO | WO-2015/143046 A2 | 9/2015 |
| WO | WO-2015/143177 A1 | 9/2015 |
| WO | WO-2015/145417 A1 | 10/2015 |
| WO | WO-2015/148431 A1 | 10/2015 |
| WO | WO-2015/148670 A1 | 10/2015 |
| WO | WO-2015/148680 A1 | 10/2015 |
| WO | WO2015/148760 * | 10/2015 |
| WO | WO-2015/148761 A1 | 10/2015 |
| WO | WO-2015/148860 A1 | 10/2015 |
| WO | WO-2015/148863 A2 | 10/2015 |
| WO | WO-2015/153760 A2 | 10/2015 |
| WO | WO-2015/153780 A1 | 10/2015 |
| WO | WO-2015/153789 A1 | 10/2015 |
| WO | WO-2015/153791 A1 | 10/2015 |
| WO | WO-2015/153889 A2 | 10/2015 |
| WO | WO-2015/153940 A1 | 10/2015 |
| WO | WO-2015/155341 A1 | 10/2015 |
| WO | WO-2015/155686 A2 | 10/2015 |
| WO | WO-2015/157070 A2 | 10/2015 |
| WO | WO-2015/157534 A1 | 10/2015 |
| WO | WO-2015/159068 A1 | 10/2015 |
| WO | WO-2015/159086 A1 | 10/2015 |
| WO | WO-2015/159087 A1 | 10/2015 |
| WO | WO-2015/160683 A1 | 10/2015 |
| WO | WO-2015/161276 A2 | 10/2015 |
| WO | WO-2015/163733 A1 | 10/2015 |
| WO | WO-2015/164740 A1 | 10/2015 |
| WO | WO-2015/164748 A1 | 10/2015 |
| WO | WO-2015/165274 A1 | 11/2015 |
| WO | WO-2015/165275 A1 | 11/2015 |
| WO | WO-2015/165276 A1 | 11/2015 |
| WO | WO-2015/166272 A2 | 11/2015 |
| WO | WO-2015/167766 A1 | 11/2015 |
| WO | WO-2015/167956 A1 | 11/2015 |
| WO | WO-2015/168125 A1 | 11/2015 |
| WO | WO-2015/168158 A1 | 11/2015 |
| WO | WO-2015/168404 A1 | 11/2015 |
| WO | WO-2015/168547 A2 | 11/2015 |
| WO | WO-2015/168800 A1 | 11/2015 |
| WO | WO-2015/171603 A1 | 11/2015 |
| WO | WO-2015/171894 A1 | 11/2015 |
| WO | WO-2015/171932 A1 | 11/2015 |
| WO | WO-2015/172128 A1 | 11/2015 |
| WO | WO-2015/173436 A1 | 11/2015 |
| WO | WO-2015/175642 A2 | 11/2015 |
| WO | WO-2015/179540 A1 | 11/2015 |
| WO | WO-2015/183025 A1 | 12/2015 |
| WO | WO-2015/183026 A1 | 12/2015 |
| WO | WO-2015/183885 A1 | 12/2015 |
| WO | WO-2015/184259 A1 | 12/2015 |
| WO | WO-2015/184262 A1 | 12/2015 |
| WO | WO-2015/184268 A1 | 12/2015 |
| WO | WO-2015/188056 A1 | 12/2015 |
| WO | WO-2015/188065 A1 | 12/2015 |
| WO | WO-2015/188094 A1 | 12/2015 |
| WO | WO-2015/188109 A1 | 12/2015 |
| WO | WO-2015/188132 A1 | 12/2015 |
| WO | WO-2015/188135 A1 | 12/2015 |
| WO | WO-2015/188191 A1 | 12/2015 |
| WO | WO-2015/189693 A1 | 12/2015 |
| WO | WO-2015/191693 A2 | 12/2015 |
| WO | WO-2015/191899 A1 | 12/2015 |
| WO | WO-2015/191911 A2 | 12/2015 |
| WO | WO-2015/193858 A1 | 12/2015 |
| WO | WO-2015/195547 A1 | 12/2015 |
| WO | WO-2015/195621 A1 | 12/2015 |
| WO | WO-2015/195798 A1 | 12/2015 |
| WO | WO-2015/198020 A1 | 12/2015 |
| WO | WO-2015/200334 A1 | 12/2015 |
| WO | WO-2015/200378 A1 | 12/2015 |
| WO | WO-2015/200555 A2 | 12/2015 |
| WO | WO-2015/200805 A2 | 12/2015 |
| WO | WO-2016/001978 A1 | 1/2016 |
| WO | WO-2016/004010 A1 | 1/2016 |
| WO | WO-2016/007347 A1 | 1/2016 |
| WO | WO-2016/007604 A1 | 1/2016 |
| WO | WO-2016/007948 A1 | 1/2016 |
| WO | WO-2016/011080 A2 | 1/2016 |
| WO | WO-2016/011210 A2 | 1/2016 |
| WO | WO-2016/011428 A1 | 1/2016 |
| WO | WO-2016/012544 A2 | 1/2016 |
| WO | WO-2016/012552 A1 | 1/2016 |
| WO | WO-2016/014409 A1 | 1/2016 |
| WO | WO-2016/014565 A2 | 1/2016 |
| WO | WO-2016/014794 A1 | 1/2016 |
| WO | WO-2016/014837 A1 | 1/2016 |
| WO | WO-2016/016119 A1 | 2/2016 |
| WO | WO-2016/016358 A1 | 2/2016 |
| WO | WO-2016/019144 A2 | 2/2016 |
| WO | WO-2016/020399 A1 | 2/2016 |
| WO | WO-2016/021972 A1 | 2/2016 |
| WO | WO-2016/021973 A1 | 2/2016 |
| WO | WO-2016/022363 A2 | 2/2016 |
| WO | WO-2016/022866 A1 | 2/2016 |
| WO | WO-2016/022931 A1 | 2/2016 |
| WO | WO-2016/025131 A1 | 2/2016 |
| WO | WO-2016/025469 A1 | 2/2016 |
| WO | WO-2016/025759 A1 | 2/2016 |
| WO | WO-2016/026444 A1 | 2/2016 |
| WO | WO-2016/028682 A1 | 2/2016 |
| WO | WO-2016/028843 A2 | 2/2016 |
| WO | WO-2016/028887 A1 | 2/2016 |
| WO | WO-2016/033088 A1 | 3/2016 |
| WO | WO-2016/033230 A1 | 3/2016 |
| WO | WO-2016/033246 A1 | 3/2016 |
| WO | WO-2016/033298 A1 | 3/2016 |
| WO | WO-2016/035044 A1 | 3/2016 |
| WO | WO-2016/036754 A1 | 3/2016 |
| WO | WO-2016/037157 A2 | 3/2016 |
| WO | WO-2016/040030 A1 | 3/2016 |
| WO | WO-2016/040594 A1 | 3/2016 |
| WO | WO-2016/044182 A1 | 3/2016 |
| WO | WO-2016/044416 A1 | 3/2016 |
| WO | WO-2016/046635 A1 | 3/2016 |
| WO | WO-2016/049024 A2 | 3/2016 |
| WO | WO-2016/049163 A2 | 3/2016 |
| WO | WO-2016/049230 A1 | 3/2016 |
| WO | WO-2016/049251 A1 | 3/2016 |
| WO | WO-2016/049258 A2 | 3/2016 |
| WO | WO-2016/053397 A2 | 4/2016 |
| WO | WO-2016/054326 A1 | 4/2016 |
| WO | WO-2016/057061 A2 | 4/2016 |
| WO | WO-2016/057821 A2 | 4/2016 |
| WO | WO-2016/057835 A2 | 4/2016 |
| WO | WO-2016/057850 A1 | 4/2016 |
| WO | WO-2016/057951 A2 | 4/2016 |
| WO | WO-2016/057961 A1 | 4/2016 |

(56) References Cited

FOREIGN PATENT DOCUMENTS

| | | |
|---|---|---|
| WO | WO-2016/061073 A1 | 4/2016 |
| WO | WO-2016/061374 A1 | 4/2016 |
| WO | WO-2016/061481 A1 | 4/2016 |
| WO | WO-2016/061523 A1 | 4/2016 |
| WO | WO-2016/064894 A2 | 4/2016 |
| WO | WO-2016/069282 A1 | 5/2016 |
| WO | WO-2016/069283 A1 | 5/2016 |
| WO | WO-2016/069591 A2 | 5/2016 |
| WO | WO-2016/069910 A1 | 5/2016 |
| WO | WO-2016/069912 A1 | 5/2016 |
| WO | WO-2016/070037 A2 | 5/2016 |
| WO | WO-2016/070070 A1 | 5/2016 |
| WO | WO-2016/070129 A1 | 5/2016 |
| WO | WO-2016/072399 A1 | 5/2016 |
| WO | WO-2016/072936 A1 | 5/2016 |
| WO | WO-2016/073433 A1 | 5/2016 |
| WO | WO-2016/073559 A1 | 5/2016 |
| WO | WO-2016/073990 A2 | 5/2016 |
| WO | WO-2016/075662 A2 | 5/2016 |
| WO | WO 2016/076672 A1 | 5/2016 |
| WO | WO-2016/077273 A1 | 5/2016 |
| WO | WO-2016/077350 A1 | 5/2016 |
| WO | WO-2016/080097 A1 | 5/2016 |
| WO | WO-2016/080795 A1 | 5/2016 |
| WO | WO-2016/081923 A2 | 5/2016 |
| WO | WO-2016/081924 A1 | 5/2016 |
| WO | WO-2016/082135 A1 | 6/2016 |
| WO | WO-2016/083811 A1 | 6/2016 |
| WO | WO-2016/084084 A1 | 6/2016 |
| WO | WO-2016/084088 A1 | 6/2016 |
| WO | WO-2016/086177 A2 | 6/2016 |
| WO | WO-2016/089433 A1 | 6/2016 |
| WO | WO-2016/089866 A1 | 6/2016 |
| WO | WO-2016/089883 A1 | 6/2016 |
| WO | WO-2016/090385 A1 | 6/2016 |
| WO | WO 2016/094679 A1 | 6/2016 |
| WO | WO-2016/094845 A2 | 6/2016 |
| WO | WO-2016/094867 A1 | 6/2016 |
| WO | WO-2016/094872 A1 | 6/2016 |
| WO | WO-2016/094874 A1 | 6/2016 |
| WO | WO-2016/094880 A1 | 6/2016 |
| WO | WO-2016/094888 A1 | 6/2016 |
| WO | WO-2016/097212 A1 | 6/2016 |
| WO | WO-2016/097231 A2 | 6/2016 |
| WO | WO-2016/097751 A1 | 6/2016 |
| WO | WO-2016/099887 A1 | 6/2016 |
| WO | WO-2016/100272 A1 | 6/2016 |
| WO | WO-2016/100389 A1 | 6/2016 |
| WO | WO-2016/100568 A1 | 6/2016 |
| WO | WO-2016/100571 A1 | 6/2016 |
| WO | WO-2016/100951 A2 | 6/2016 |
| WO | WO-2016/100955 A2 | 6/2016 |
| WO | WO-2016/100974 A1 | 6/2016 |
| WO | WO-2016/103233 A2 | 6/2016 |
| WO | WO-2016/104716 A1 | 6/2016 |
| WO | WO-2016/106236 A1 | 6/2016 |
| WO | WO-2016/106239 A1 | 6/2016 |
| WO | WO-2016/106244 A1 | 6/2016 |
| WO | WO-2016/106338 A2 | 6/2016 |
| WO | WO-2016/108926 A1 | 7/2016 |
| WO | WO-2016/109255 A1 | 7/2016 |
| WO | WO-2016/109840 A2 | 7/2016 |
| WO | WO-2016/110214 A1 | 7/2016 |
| WO | WO-2016/110453 A1 | 7/2016 |
| WO | WO-2016/110511 A1 | 7/2016 |
| WO | WO-2016/110512 A1 | 7/2016 |
| WO | WO 2016/111546 A2 | 7/2016 |
| WO | WO-2016/112242 A1 | 7/2016 |
| WO | WO-2016/112351 A1 | 7/2016 |
| WO | WO-2016/112963 A1 | 7/2016 |
| WO | WO-2016/114972 A1 | 7/2016 |
| WO | WO-2016/115179 A1 | 7/2016 |
| WO | WO-2016/115326 A1 | 7/2016 |
| WO | WO-2016/115355 A1 | 7/2016 |
| WO | WO-2016/116032 A1 | 7/2016 |
| WO | WO-2016/120480 A1 | 8/2016 |
| WO | WO-2016/123071 A1 | 8/2016 |
| WO | WO-2016/123230 A1 | 8/2016 |
| WO | WO-2016/123243 A1 | 8/2016 |
| WO | WO-2016/123578 A1 | 8/2016 |
| WO | WO 2016/126747 A1 | 8/2016 |
| WO | WO-2016/130600 A2 | 8/2016 |
| WO | WO-2016/130697 A1 | 8/2016 |
| WO | WO 2016/131009 A1 | 8/2016 |
| WO | WO-2016/132122 A1 | 8/2016 |
| WO | WO-2016/133165 A1 | 8/2016 |
| WO | WO-2016/135507 A1 | 9/2016 |
| WO | WO-2016/135557 A2 | 9/2016 |
| WO | WO-2016/135558 A2 | 9/2016 |
| WO | WO-2016/135559 A2 | 9/2016 |
| WO | WO-2016/137774 A1 | 9/2016 |
| WO | WO-2016/137949 A1 | 9/2016 |
| WO | WO-2016/141224 A1 | 9/2016 |
| WO | WO-2016/141893 A1 | 9/2016 |
| WO | WO-2016/142719 A1 | 9/2016 |
| WO | WO-2016/145150 A2 | 9/2016 |
| WO | WO-2016/148994 A1 | 9/2016 |
| WO | WO-2016/149484 A2 | 9/2016 |
| WO | WO-2016/149547 A1 | 9/2016 |
| WO | WO-2016/150336 A1 | 9/2016 |
| WO | WO-2016/150855 A1 | 9/2016 |
| WO | WO-2016/154016 A2 | 9/2016 |
| WO | WO-2016/154579 A2 | 9/2016 |
| WO | WO-2016/154596 A1 | 9/2016 |
| WO | WO-2016/155482 A1 | 10/2016 |
| WO | WO-2016/161004 A1 | 10/2016 |
| WO | WO-2016/161207 A1 | 10/2016 |
| WO | WO-2016/161260 A1 | 10/2016 |
| WO | WO-2016/161380 A1 | 10/2016 |
| WO | WO-2016/161446 A1 | 10/2016 |
| WO | WO-2016/164356 A1 | 10/2016 |
| WO | WO-2016/164797 A1 | 10/2016 |
| WO | WO-2016/166340 A1 | 10/2016 |
| WO | WO-2016/167300 A1 | 10/2016 |
| WO | WO-2016/170484 A1 | 10/2016 |
| WO | WO-2016/172359 A2 | 10/2016 |
| WO | WO-2016/172727 A1 | 10/2016 |
| WO | WO-2016/174056 A1 | 11/2016 |
| WO | WO-2016/174151 A1 | 11/2016 |
| WO | WO-2016/174250 A1 | 11/2016 |
| WO | WO-2016/176191 A1 | 11/2016 |
| WO | WO-2016/176404 A1 | 11/2016 |
| WO | WO-2016/176690 A2 | 11/2016 |
| WO | WO-2016/177682 A1 | 11/2016 |
| WO | WO-2016/178207 A1 | 11/2016 |
| WO | WO-2016/179038 A1 | 11/2016 |
| WO | WO-2016/179112 A1 | 11/2016 |
| WO | WO-2016/181357 A1 | 11/2016 |
| WO | WO-2016/182893 A1 | 11/2016 |
| WO | WO-2016/182917 A1 | 11/2016 |
| WO | WO-2016/182959 A1 | 11/2016 |
| WO | WO-2016/183236 A1 | 11/2016 |
| WO | WO-2016/183298 A2 | 11/2016 |
| WO | WO-2016/183345 A1 | 11/2016 |
| WO | WO-2016/183402 A2 | 11/2016 |
| WO | WO-2016/183438 A1 | 11/2016 |
| WO | WO-2016/183448 A1 | 11/2016 |
| WO | WO-2016/184955 A2 | 11/2016 |
| WO | WO-2016/184989 A1 | 11/2016 |
| WO | WO-2016/185411 A1 | 11/2016 |
| WO | WO-2016/186745 A1 | 11/2016 |
| WO | WO-2016/186772 A2 | 11/2016 |
| WO | WO-2016/186946 A1 | 11/2016 |
| WO | WO-2016/186953 A1 | 11/2016 |
| WO | WO-2016/187717 A1 | 12/2016 |
| WO | WO-2016/187904 A1 | 12/2016 |
| WO | WO-2016/191684 A1 | 12/2016 |
| WO | WO-2016/191869 A1 | 12/2016 |
| WO | WO-2016/196273 A1 | 12/2016 |
| WO | WO-2016/196282 A1 | 12/2016 |
| WO | WO-2016/196308 A1 | 12/2016 |
| WO | WO-2016/196361 A1 | 12/2016 |
| WO | WO-2016/196499 A1 | 12/2016 |
| WO | WO-2016/196539 A2 | 12/2016 |

(56) References Cited

FOREIGN PATENT DOCUMENTS

| | | |
|---|---|---|
| WO | WO-2016/196655 A1 | 12/2016 |
| WO | WO-2016/196805 A1 | 12/2016 |
| WO | WO-2016/196887 A1 | 12/2016 |
| WO | WO-2016/197132 A1 | 12/2016 |
| WO | WO-2016/197133 A1 | 12/2016 |
| WO | WO-2016/197354 A1 | 12/2016 |
| WO | WO-2016/197355 A1 | 12/2016 |
| WO | WO-2016/197356 A1 | 12/2016 |
| WO | WO-2016/197357 A1 | 12/2016 |
| WO | WO-2016/197358 A1 | 12/2016 |
| WO | WO-2016/197359 A1 | 12/2016 |
| WO | WO-2016/197360 A1 | 12/2016 |
| WO | WO-2016/197361 A1 | 12/2016 |
| WO | WO-2016/197362 A1 | 12/2016 |
| WO | WO-2016/198361 A1 | 12/2016 |
| WO | WO-2016/198500 A1 | 12/2016 |
| WO | WO-2016/200263 A1 | 12/2016 |
| WO | WO-2016/201047 A1 | 12/2016 |
| WO | WO-2016/201138 A1 | 12/2016 |
| WO | WO-2016/201152 A1 | 12/2016 |
| WO | WO-2016/201153 A1 | 12/2016 |
| WO | WO-2016/201155 A1 | 12/2016 |
| WO | WO-2016/205276 A1 | 12/2016 |
| WO | WO-2016/205613 A1 | 12/2016 |
| WO | WO-2016/205623 A1 | 12/2016 |
| WO | WO-2016/205680 A1 | 12/2016 |
| WO | WO-2016/205688 A2 | 12/2016 |
| WO | WO-2016/205703 A1 | 12/2016 |
| WO | WO-2016/205711 A1 | 12/2016 |
| WO | WO-2016/205728 A1 | 12/2016 |
| WO | WO-2016/205745 A2 | 12/2016 |
| WO | WO-2016/205749 A1 | 12/2016 |
| WO | WO-2016/205759 A1 | 12/2016 |
| WO | WO-2016/205764 A1 | 12/2016 |
| WO | WO-2017/001572 A1 | 1/2017 |
| WO | WO-2017/001988 A1 | 1/2017 |
| WO | WO-2017/004261 A1 | 1/2017 |
| WO | WO-2017/004279 A2 | 1/2017 |
| WO | WO-2017/004616 A1 | 1/2017 |
| WO | WO-2017/005807 A1 | 1/2017 |
| WO | WO-2017/009399 A1 | 1/2017 |
| WO | WO 2017/010556 A1 | 1/2017 |
| WO | WO-2017/011519 A1 | 1/2017 |
| WO | WO-2017/011721 A1 | 1/2017 |
| WO | WO-2017/011804 A1 | 1/2017 |
| WO | WO-2017/015015 A1 | 1/2017 |
| WO | WO-2017/015101 A1 | 1/2017 |
| WO | WO-2017/015567 A1 | 1/2017 |
| WO | WO-2017/015637 A1 | 1/2017 |
| WO | WO-2017/017016 A1 | 2/2017 |
| WO | WO-2017/019867 A1 | 2/2017 |
| WO | WO-2017/019895 A1 | 2/2017 |
| WO | WO-2017/023803 A1 | 2/2017 |
| WO | WO-2017/023974 A1 | 2/2017 |
| WO | WO-2017/024047 A1 | 2/2017 |
| WO | WO-2017/024319 A1 | 2/2017 |
| WO | WO-2017/024343 A1 | 2/2017 |
| WO | WO-2017/024602 A1 | 2/2017 |
| WO | WO-2017/025323 A1 | 2/2017 |
| WO | WO-2017/027423 A1 | 2/2017 |
| WO | WO-2017/028768 A1 | 2/2017 |
| WO | WO-2017/029664 A1 | 2/2017 |
| WO | WO-2017/031360 A1 | 2/2017 |
| WO | WO-2017/031483 A1 | 2/2017 |
| WO | WO-2017/035416 A2 | 3/2017 |
| WO | WO-2017/040348 A1 | 3/2017 |
| WO | WO-2017/040511 A1 | 3/2017 |
| WO | WO-2017/040709 A1 | 3/2017 |
| WO | WO-2017/040786 A1 | 3/2017 |
| WO | WO-2017/040793 A1 | 3/2017 |
| WO | WO-2017/040813 A2 | 3/2017 |
| WO | WO-2017/043573 A1 | 3/2017 |
| WO | WO-2017/043656 A1 | 3/2017 |
| WO | WO-2017/044419 A1 | 3/2017 |
| WO | WO-2017/044776 A1 | 3/2017 |
| WO | WO-2017/044857 A2 | 3/2017 |
| WO | WO-2017/049129 A2 | 3/2017 |
| WO | WO-2017/050963 A1 | 3/2017 |
| WO | WO-2017/053312 A1 | 3/2017 |
| WO | WO-2017/053431 A2 | 3/2017 |
| WO | WO-2017/053713 A1 | 3/2017 |
| WO | WO-2017/053729 A1 | 3/2017 |
| WO | WO-2017/053753 A1 | 3/2017 |
| WO | WO-2017/053762 A1 | 3/2017 |
| WO | WO-2017/053879 A1 | 3/2017 |
| WO | WO 2017/054721 A1 | 4/2017 |
| WO | WO-2017/058658 A2 | 4/2017 |
| WO | WO 2017/059241 A1 | 4/2017 |
| WO | WO-2017/062605 A1 | 4/2017 |
| WO | WO-2017/062723 A1 | 4/2017 |
| WO | WO-2017/062754 A1 | 4/2017 |
| WO | WO-2017/062855 A1 | 4/2017 |
| WO | WO-2017/062886 A1 | 4/2017 |
| WO | WO-2017/062983 A1 | 4/2017 |
| WO | WO-2017/064439 A1 | 4/2017 |
| WO | WO-2017/064546 A1 | 4/2017 |
| WO | WO-2017/064566 A2 | 4/2017 |
| WO | WO-2017/066175 A1 | 4/2017 |
| WO | WO-2017/066497 A2 | 4/2017 |
| WO | WO-2017/066588 A2 | 4/2017 |
| WO | WO 2017/066707 A1 | 4/2017 |
| WO | WO 2017/068077 A1 | 4/2017 |
| WO | WO-2017/068377 A1 | 4/2017 |
| WO | WO-2017/069829 A2 | 4/2017 |
| WO | WO-2017/070029 A1 | 4/2017 |
| WO | WO-2017/070032 A1 | 4/2017 |
| WO | WO-2017/070169 A1 | 4/2017 |
| WO | WO-2017/070284 A1 | 4/2017 |
| WO | WO-2017/070598 A1 | 4/2017 |
| WO | WO-2017/070605 A1 | 4/2017 |
| WO | WO-2017/070632 A2 | 4/2017 |
| WO | WO-2017/070633 A2 | 4/2017 |
| WO | WO-2017/072590 A1 | 5/2017 |
| WO | WO-2017/074526 A1 | 5/2017 |
| WO | WO-2017/074962 A1 | 5/2017 |
| WO | WO-2017/075261 A1 | 5/2017 |
| WO | WO 2017/075335 A1 | 5/2017 |
| WO | WO-2017/075475 A1 | 5/2017 |
| WO | WO-2017/077135 A1 | 5/2017 |
| WO | WO-2017/077329 A2 | 5/2017 |
| WO | WO-2017/078751 A1 | 5/2017 |
| WO | WO-2017/079400 A1 | 5/2017 |
| WO | WO-2017/079428 A1 | 5/2017 |
| WO | WO-2017/079673 A1 | 5/2017 |
| WO | WO-2017/079724 A1 | 5/2017 |
| WO | WO-2017/081097 A1 | 5/2017 |
| WO | WO-2017/081288 A1 | 5/2017 |
| WO | WO-2017/083368 A1 | 5/2017 |
| WO | WO-2017/083722 A1 | 5/2017 |
| WO | WO-2017/083766 A1 | 5/2017 |
| WO | WO-2017/087395 A1 | 5/2017 |
| WO | WO-2017/090724 A1 | 6/2017 |
| WO | WO-2017/091510 A1 | 6/2017 |
| WO | WO-2017/091630 A1 | 6/2017 |
| WO | WO-2017/092201 A1 | 6/2017 |
| WO | WO-2017/093370 A1 | 6/2017 |
| WO | WO-2017/095111 A1 | 6/2017 |
| WO | WO-2017/096041 A1 | 6/2017 |
| WO | WO-2017/096237 A1 | 6/2017 |
| WO | WO-2017/100158 A1 | 6/2017 |
| WO | WO-2017/100431 A2 | 6/2017 |
| WO | WO-2017/104404 A1 | 6/2017 |
| WO | WO-2017/105251 A1 | 6/2017 |
| WO | WO-2017/105350 A1 | 6/2017 |
| WO | WO-2017/105991 A1 | 6/2017 |
| WO | WO-2017/106414 A1 | 6/2017 |
| WO | WO-2017/106528 A2 | 6/2017 |
| WO | WO-2017/106537 A2 | 6/2017 |
| WO | WO-2017/106569 A1 | 6/2017 |
| WO | WO-2017/106616 A1 | 6/2017 |
| WO | WO-2017/106657 A1 | 6/2017 |
| WO | WO-2017/106767 A1 | 6/2017 |
| WO | WO 2017/109134 A1 | 6/2017 |
| WO | WO 2017/109757 A1 | 6/2017 |

(56) References Cited

FOREIGN PATENT DOCUMENTS

| | | |
|---|---|---|
| WO | WO-2017/112620 A1 | 6/2017 |
| WO | WO-2017/115268 A1 | 7/2017 |
| WO | WO-2017/117395 A1 | 7/2017 |
| WO | WO 2017/118598 A1 | 7/2017 |
| WO | WO-2017/118720 A1 | 7/2017 |
| WO | WO-2017/123609 A1 | 7/2017 |
| WO | WO-2017/123910 A1 | 7/2017 |
| WO | WO-2017/124086 A1 | 7/2017 |
| WO | WO-2017/124100 A1 | 7/2017 |
| WO | WO-2017/124652 A1 | 7/2017 |
| WO | WO-2017/126987 A1 | 7/2017 |
| WO | WO-2017/127807 A1 | 7/2017 |
| WO | WO-2017/131237 A1 | 8/2017 |
| WO | WO-2017/132112 A1 | 8/2017 |
| WO | WO 2017/132580 A2 | 8/2017 |
| WO | WO-2017/136520 A1 | 8/2017 |
| WO | WO-2017/136629 A1 | 8/2017 |
| WO | WO-2017/136794 A1 | 8/2017 |
| WO | WO-2017/139264 A1 | 8/2017 |
| WO | WO-2017/139505 A2 | 8/2017 |
| WO | WO 2017/141173 A2 | 8/2017 |
| WO | WO-2017/142835 A1 | 8/2017 |
| WO | WO-2017/142999 A2 | 8/2017 |
| WO | WO-2017/143042 A2 | 8/2017 |
| WO | WO-2017/147278 A1 | 8/2017 |
| WO | WO-2017/147432 A1 | 8/2017 |
| WO | WO-2017/147446 A1 | 8/2017 |
| WO | WO-2017/147555 A1 | 8/2017 |
| WO | WO-2017/151444 A1 | 9/2017 |
| WO | WO-2017/152015 A1 | 9/2017 |
| WO | WO 2017/155717 A1 | 9/2017 |
| WO | WO-2017/157422 A1 | 9/2017 |
| WO | WO-2017/158153 A1 | 9/2017 |
| WO | WO-2017/160689 A1 | 9/2017 |
| WO | WO-2017/160752 A1 | 9/2017 |
| WO | WO-2017/160890 A1 | 9/2017 |
| WO | WO-2017/161068 A1 | 9/2017 |
| WO | WO-2017/165826 A1 | 9/2017 |
| WO | WO-2017/165862 A1 | 9/2017 |
| WO | WO-2017/172644 A2 | 10/2017 |
| WO | WO-2017/172645 A2 | 10/2017 |
| WO | WO-2017/172860 A1 | 10/2017 |
| WO | WO-2017/173004 A1 | 10/2017 |
| WO | WO-2017/173054 A1 | 10/2017 |
| WO | WO-2017/173092 A1 | 10/2017 |
| WO | WO-2017/174329 A1 | 10/2017 |
| WO | WO-2017/176529 A1 | 10/2017 |
| WO | WO 2017/176806 A1 | 10/2017 |
| WO | WO-2017/178590 A1 | 10/2017 |
| WO | WO-2017/180694 A1 | 10/2017 |
| WO | WO-2017/180711 A1 | 10/2017 |
| WO | WO-2017/180915 A2 | 10/2017 |
| WO | WO-2017/180926 A1 | 10/2017 |
| WO | WO-2017/181107 A2 | 10/2017 |
| WO | WO-2017/181735 A2 | 10/2017 |
| WO | WO-2017/182468 A1 | 10/2017 |
| WO | WO-2017/184334 A1 | 10/2017 |
| WO | WO-2017/184768 A1 | 10/2017 |
| WO | WO-2017/184786 A1 | 10/2017 |
| WO | WO-2017/186550 A1 | 11/2017 |
| WO | WO-2017/189308 A1 | 11/2017 |
| WO | WO-2017/189336 A1 | 11/2017 |
| WO | WO-2017/190257 A1 | 11/2017 |
| WO | WO-2017/190664 A1 | 11/2017 |
| WO | WO-2017/191210 A1 | 11/2017 |
| WO | WO-2017/192172 A1 | 11/2017 |
| WO | WO-2017/192512 A2 | 11/2017 |
| WO | WO-2017/192544 A1 | 11/2017 |
| WO | WO-2017/192573 A1 | 11/2017 |
| WO | WO-2017/193029 A2 | 11/2017 |
| WO | WO-2017/193053 A1 | 11/2017 |
| WO | WO-2017/196768 A1 | 11/2017 |
| WO | WO-2017/197038 A1 | 11/2017 |
| WO | WO-2017/197238 A1 | 11/2017 |
| WO | WO-2017/197301 A1 | 11/2017 |
| WO | WO 2017/201476 A1 | 11/2017 |
| WO | WO-2017/205290 A1 | 11/2017 |
| WO | WO-2017/205423 A1 | 11/2017 |
| WO | WO-2017/207589 A1 | 12/2017 |
| WO | WO-2017/208247 A1 | 12/2017 |
| WO | WO-2017/209809 A1 | 12/2017 |
| WO | WO-2017/213896 A1 | 12/2017 |
| WO | WO-2017/213898 A2 | 12/2017 |
| WO | WO-2017/214460 A1 | 12/2017 |
| WO | WO-2017/216392 A1 | 12/2017 |
| WO | WO-2017/216771 A2 | 12/2017 |
| WO | WO 2017/218185 A1 | 12/2017 |
| WO | WO-2017/219027 A1 | 12/2017 |
| WO | WO-2017/219033 A1 | 12/2017 |
| WO | WO-2017/220751 A1 | 12/2017 |
| WO | WO-2017/222370 A1 | 12/2017 |
| WO | WO-2017/222773 A1 | 12/2017 |
| WO | WO-2017/222834 A1 | 12/2017 |
| WO | WO-2017/223107 A1 | 12/2017 |
| WO | WO-2017/223330 A1 | 12/2017 |
| WO | WO-2018/000657 A1 | 1/2018 |
| WO | WO-2018/002719 A1 | 1/2018 |
| WO | WO-2018/005117 A1 | 1/2018 |
| WO | WO-2018/005289 A2 | 1/2018 |
| WO | WO-2018/005691 A1 | 1/2018 |
| WO | WO-2018/005782 A1 | 1/2018 |
| WO | WO-2018/005873 A1 | 1/2018 |
| WO | WO 2018/06693 A1 | 1/2018 |
| WO | WO-2018/009520 A1 | 1/2018 |
| WO | WO-2018/009562 A1 | 1/2018 |
| WO | WO-2018/009822 A1 | 1/2018 |
| WO | WO-2018/013821 A1 | 1/2018 |
| WO | WO-2018/013990 A1 | 1/2018 |
| WO | WO 2018/014384 A1 | 1/2018 |
| WO | WO 2018/015444 A1 | 1/2018 |
| WO | WO 2018/015936 A2 | 1/2018 |
| WO | WO 2018/017754 A1 | 1/2018 |
| WO | WO 2018/018979 A1 | 2/2018 |
| WO | WO 2018/020248 A1 | 2/2018 |
| WO | WO 2018/022480 A1 | 2/2018 |
| WO | WO 2018/022634 A1 | 2/2018 |
| WO | WO 2018/025206 A1 | 2/2018 |
| WO | WO 2018/026723 A1 | 2/2018 |
| WO | WO 2018/026976 A1 | 2/2018 |
| WO | WO 2018/027078 A1 | 2/2018 |
| WO | WO 2018/030608 A1 | 2/2018 |
| WO | WO 2018/031683 A1 | 2/2018 |
| WO | WO 2018/035250 A1 | 2/2018 |
| WO | WO 2018/035300 A1 | 2/2018 |
| WO | WO 2018/035423 A1 | 2/2018 |
| WO | WO 2018/035503 A1 | 2/2018 |
| WO | WO 2018/039145 A1 | 3/2018 |
| WO | WO 2018/039438 A1 | 3/2018 |
| WO | WO 2018/039440 A1 | 3/2018 |
| WO | WO 2018/039448 A1 | 3/2018 |
| WO | WO 2018/045630 A1 | 3/2018 |
| WO | WO 2018/048827 A1 | 3/2018 |
| WO | WO 2018/049168 A1 | 3/2018 |
| WO | WO 2018/051347 A1 | 3/2018 |
| WO | WO 2018/058064 A1 | 3/2018 |
| WO | WO 2018/062866 A2 | 4/2018 |
| WO | WO 2018/064352 A1 | 4/2018 |
| WO | WO 2018/064371 A1 | 4/2018 |
| WO | WO 2018/064516 A1 | 4/2018 |
| WO | WO 2018/067546 A1 | 4/2018 |
| WO | WO 2018/067846 A1 | 4/2018 |
| WO | WO 2018/068053 A2 | 4/2018 |
| WO | WO 2018/069474 A1 | 4/2018 |
| WO | WO 2018/071623 A2 | 4/2018 |
| WO | WO 2018/071663 A1 | 4/2018 |
| WO | WO 2018/071868 A1 | 4/2018 |
| WO | WO 2018/071892 A1 | 4/2018 |
| WO | WO 2018/074979 | 4/2018 |
| WO | WO 2018/079134 A1 | 5/2018 |
| WO | WO 2018/080573 A1 | 5/2018 |
| WO | WO 2018/081504 A1 | 5/2018 |
| WO | WO 2018/081535 A2 | 5/2018 |
| WO | WO 2018/081728 A1 | 5/2018 |
| WO | WO 2018/083128 A2 | 5/2018 |

(56) References Cited

FOREIGN PATENT DOCUMENTS

| | | |
|---|---|---|
| WO | WO 2018/083606 A1 | 5/2018 |
| WO | WO 2018/085288 A1 | 5/2018 |
| WO | WO 2018/086623 A1 | 5/2018 |
| WO | WO 2018/093990 A1 | 5/2018 |
| WO | WO 2018/098383 A1 | 5/2018 |
| WO | WO 2018/098480 A1 | 5/2018 |
| WO | WO 2018/098587 A1 | 6/2018 |
| WO | WO 2018/099256 A1 | 6/2018 |
| WO | WO 2018/103686 A1 | 6/2018 |
| WO | WO 2018/106268 A1 | 6/2018 |
| WO | WO 2018/107028 A1 | 6/2018 |
| WO | WO 2018/107103 A1 | 6/2018 |
| WO | WO 2018/107129 A1 | 6/2018 |
| WO | WO 2018/108272 A1 | 6/2018 |
| WO | WO 2018/109101 A1 | 6/2018 |
| WO | WO 2018/111946 A1 | 6/2018 |
| WO | WO 2018/111947 A1 | 6/2018 |
| WO | WO 2018/112336 A1 | 6/2018 |
| WO | WO 2018/112446 A2 | 6/2018 |
| WO | WO 2018/119354 A1 | 6/2018 |
| WO | WO 2018/119359 A1 | 6/2018 |
| WO | WO 2018/130830 A1 | 7/2018 |
| WO | WO 2018/135838 A1 | 7/2018 |
| WO | WO 2018/136396 A2 | 7/2018 |
| WO | WO 2018/138385 A1 | 8/2018 |
| WO | WO 2018/148246 A1 | 8/2018 |
| WO | WO 2018/148256 A1 | 8/2018 |
| WO | WO 2018/148647 A1 | 8/2018 |
| WO | WO 2018/149418 A1 | 8/2018 |
| WO | WO 2018/149888 A1 | 8/2018 |
| WO | WO 2018/152418 A1 | 8/2018 |
| WO | WO 2018/154380 A1 | 8/2018 |
| WO | WO 2018/154387 A1 | 8/2018 |
| WO | WO 2018/154412 A1 | 8/2018 |
| WO | WO 2018/154413 A1 | 8/2018 |
| WO | WO 2018/154418 A1 | 8/2018 |
| WO | WO 2018/154439 A1 | 8/2018 |
| WO | WO 2018/154459 A1 | 8/2018 |
| WO | WO 2018/154462 A1 | 8/2018 |
| WO | WO 2018/156372 A1 | 8/2018 |
| WO | WO 2018/161009 A1 | 9/2018 |
| WO | WO 2018/165504 A1 | 9/2018 |
| WO | WO 2018/165629 A1 | 9/2018 |
| WO | WO 2018/170015 A1 | 9/2018 |
| WO | WO 2018/170340 A1 | 9/2018 |
| WO | WO 2018/175502 A2 | 9/2018 |
| WO | WO 2018/177351 A1 | 10/2018 |
| WO | WO 2018/179578 A1 | 10/2018 |
| WO | WO 2018/183403 A1 | 10/2018 |
| WO | WO 2018/195545 A2 | 10/2018 |
| WO | WO 2018/195555 A1 | 10/2018 |
| WO | WO 2018/197020 A1 | 11/2018 |
| WO | WO 2018/197495 A1 | 11/2018 |
| WO | WO 2018/202800 A1 | 11/2018 |
| WO | WO 2018/204493 A1 | 11/2018 |
| WO | WO 2018/208755 A1 | 11/2018 |
| WO | WO 2018/208998 A1 | 11/2018 |
| WO | WO 2018/209158 A2 | 11/2018 |
| WO | WO 2018/209320 A1 | 11/2018 |
| WO | WO 2018/213708 A1 | 11/2018 |
| WO | WO 2018/213726 A1 | 11/2018 |
| WO | WO 2018/213771 A1 | 11/2018 |
| WO | WO 2018/213791 A1 | 11/2018 |
| WO | WO 2018/217852 A1 | 11/2018 |
| WO | WO 2018/217981 A1 | 11/2018 |
| WO | WO 2018/218166 A1 | 11/2018 |
| WO | WO 2018/218188 A2 | 11/2018 |
| WO | WO 2018/218206 A1 | 11/2018 |
| WO | WO 2019/079347 A1 | 4/2019 |
| WO | WO 2019/118949 A1 | 6/2019 |
| WO | WO 2019/139645 A2 | 7/2019 |
| WO | WO 2019/226953 A1 | 11/2019 |
| WO | WO 2020/014261 A1 | 1/2020 |
| WO | WO 2020/041751 A1 | 2/2020 |

OTHER PUBLICATIONS

[No Author Listed], Invitrogen Lipofectamine™ LTX product sheets, 2011. 4 pages.

[No Author Listed], Thermo Fisher Scientific—How Cationic Lipid Mediated Transfection Works, retrieved from the internet Aug. 27, 2015. 2 pages.

Abudayyeh et al., C2c2 is a single-component programmable RNA-guided RNA-targeting CRISPR effector. Science Aug. 2016;353(6299):aaf5573. DOI: 10.1126/science.aaf5573.

Addgene Plasmid # 44246. pdCas9-humanized, 2017, Stanley Qi.

Addgene Plasmid # 73021. PCMV-BE3, 2017, David Liu.

Addgene Plasmid # 79620. pcDNA3.1_pCMV-nCas-PmCDA1-ugi pH1-gRNA(HPRT), 2017, Akihiko Kondo.

Alexandrov et al., Signatures of mutational processes in human cancer. Nature. Aug. 22, 2013;500(7463):415-21. doi: 10.1038/nature12477. Epub Aug. 14, 2013.

Anders et al., Structural basis of PAM-dependent target DNA recognition by the Cas9 endonuclease. Nature. Sep. 25, 2014;513(7519):569-73. doi: 10.1038/nature13579. Epub Jul. 27, 2014.

Arnold et al., Mutants of Tn3 resolvase which do not require accessory binding sites for recombination activity. EMBO J. Mar. 1, 1999;18(5):1407-14.

Barnes et al., Repair and genetic consequences of endogenous DNA base damage in mammalian cells. Annu Rev Genet. 2004;38:445-76.

Barrangou et al., CRISPR provides acquired resistance against viruses in prokaryotes. Science. Mar. 23, 2007;315(5819):1709-12.

Barrangou, RNA-mediated programmable DNA cleavage. Nat Biotechnol. Sep. 2012;30(9):836-8. doi: 10.1038/nbt.2357.

Basha et al., Influence of cationic lipid composition on gene silencing properties of lipid nanoparticle formulations of siRNA in antigen-presenting cells. Mol Ther. Dec. 2011;19(12):2186-200. doi: 10.1038/mt.2011.190. Epub Oct. 4, 2011.

Beale et al., Comparison of the differential context-dependence of DNA deamination by APOBEC enzymes: correlation with mutation spectra in vivo. J Mol Biol. Mar. 26, 2004;337(3):585-96.

Bedell et al., In vivo genome editing using a high-efficiency TALEN system. Nature. Nov. 1, 2012;491(7422):114-8. Doi: 10.1038/nature11537. Epub Sep. 23, 2012.

Begley, Scientists unveil the 'most clever CRISPR gadget' so far. STAT, Apr. 20, 2016. https://www.statnews.com/2016/04/20/clever-crispr-advance-unveiled/.

Beumer et al., Efficient gene targeting in *Drosophila* with zinc-finger nucleases. Genetics. Apr. 2006;172(4):2391-403. Epub Feb. 1, 2006.

Birling et al., Site-specific recombinases for manipulation of the mouse genome. Methods Mol Biol. 2009;561:245-63. doi: 10.1007/978-1-60327-019-9_16.

Bitinaite et al., FokI dimerization is required for DNA cleavage. Proc Natl Acad Sci U S A. Sep. 1, 1998;95(18):10570-5.

Boch, TALEs of genome targeting. Nat Biotechnol. Feb. 2011;29(2):135-6. Doi: 10.1038/nbt.1767.

Boeckle et al., Melittin analogs with high lytic activity at endosomal pH enhance transfection with purified targeted PEI polyplexes. J Control Release. May 15, 2006;112(2):240-8. Epub Mar. 20, 2006.

Borman, Improved route to single-base genome editing. Chemical & Engineering News, Apr. 25, 2016;94(17)p5. http://cen.acs.org/articles/94/i17/Improved-route-single-base-genome.html.

Branden and Tooze, Introduction to Protein Structure. 1999; 2nd edition. Garland Science Publisher: 3-12.

Britt et al., Re-engineering plant gene targeting. Trends Plant Sci. Feb. 2003;8(2):90-5.

Brown et al., Serine recombinases as tools for genome engineering. Methods. Apr. 2011;53(4):372-9. doi: 10.1016/j.ymeth.2010.12.031. Epub Dec. 30, 2010.

Brusse et al., Spinocerebellar ataxia associated with a mutation in the fibroblast growth factor 14 gene (SCA27): A new phenotype. Mov Disord. Mar. 2006;21(3):396-401.

Buchholz et al., Alteration of Cre recombinase site specificity by substrate-linked protein evolution. Nat Biotechnol. Nov. 2001;19(11):1047-52.

(56) References Cited

OTHER PUBLICATIONS

Bulow et al., Multienzyme systems obtained by gene fusion. Trends Biotechnol. Jul. 1991;9(7):226-31.

Burstein et al., New CRISPR-Cas systems from uncultivated microbes. Nature Feb. 2017;542(7640):237-240.

Cade et al., Highly efficient generation of heritable zebrafish gene mutations using homo- and heterodimeric TALENs. Nucleic Acids Res. Sep. 2012;40(16):8001-10. Doi: 10.1093/nar/gks518. Epub Jun. 7, 2012.

Caldecott et al., Single-strand break repair and genetic disease. Nat Rev Genet. Aug. 2008;9(8):619-31. doi: 10.1038/nrg2380.

Cameron, Recent advances in transgenic technology. Mol Biotechnol. Jun. 1997;7(3):253-65.

Cargill et al.,Characterization of single-nucleotide polymorphisms in coding regions of human genes. Nat Genet. Jul. 1999;22(3):231-8.

Caron et al., Intracellular delivery of a Tat-eGFP fusion protein into muscle cells. Mol Ther. Mar. 2001;3(3):310-8.

Carroll et al., Gene targeting in *Drosophila* and Caenorhabditis elegans with zinc-finger nucleases. Methods Mol Biol. 2008;435:63-77. doi: 10.1007/978-1-59745-232-8_5.

Carroll et al., Progress and prospects: zinc-finger nucleases as gene therapy agents. Gene Ther. Nov. 2008;15(22):1463-8. doi: 10.1038/gt.2008.145. Epub Sep. 11, 2008.

Carroll, A CRISPR approach to gene targeting. Mol Ther. Sep. 2012;20(9):1658-60. doi: 10.1038/mt.2012.171.

Cermak et al., Efficient design and assembly of custom TALEN and other TAL effector-based constructs for DNA targeting. Nucleic Acids Res. Jul. 2011;39(12):e82. Doi: 10.1093/nar/gkr218. Epub Apr. 14, 2011.

Chadwick et al., In Vivo Base Editing of PCSK9 (Proprotein Convertase Subtilisin/Kexin Type 9) as a Therapeutic Alternative to Genome Editing. Arterioscler Thromb Vasc Biol. Sep. 2017;37(9):1741-1747. doi: 10.1161/ATVBAHA.117.309881. Epub Jul. 27, 2017.

Chaikind et al., A programmable Cas9-serine recombinase fusion protein that operates on DNA sequences in mammalian cells. Nucleic Acids Res. Nov. 16, 2016;44(20):9758-9770. Epub Aug. 11, 2016.

Charpentier et al., Biotechnology: Rewriting a genome. Nature. Mar. 7, 2013;495(7439):50-1. doi: 10.1038/495050a.

Chavez et al., Highly efficient Cas9-mediated transcriptional programming. Nat Methods. Apr. 2015;12(4):326-8. doi: 10.1038/nmeth.3312. Epub Mar. 2, 2015.

Chavez et al., Precise Cas9 targeting enables genomic mutation prevention. Jun. 14, 2016. doi:https://doi.org/10.1101/058974. [Preprint].

Chelico et al., Biochemical basis of immunological and retroviral responses to DNA-targeted cytosine deamination by activation-induced cytidine deaminase and APOBEC3G. J Biol Chem. Oct. 9, 2009;284(41):27761-5. doi: 10.1074/jbc.R109.052449. Epub Aug. 13, 2009.

Chen et al., Structure of the DNA deaminase domain of the HIV-1 restriction factor APOBEC3G. Nature. Mar. 6, 2008;452(7183):116-9. doi: 10.1038/nature06638. Epub Feb. 20, 2008.

Chesnoy et al., Structure and function of lipid-DNA complexes for gene delivery. Annu Rev Biophys Biomol Struct. 2000;29:27-47.

Chew et al., A multifunctional AAV-CRISPR-Cas9 and its host response. Nat Methods. Oct. 2016;13(10):868-74. doi: 10.1038/nmeth.3993. Epub Sep. 5, 2016.

Chichili et al., Linkers in the structural biology of protein-protein interactions. Protein Science. 2013;22:153-67.

Chipev et al., A leucine—proline mutation in the H1 subdomain of keratin 1 causes epidermolytic hyperkeratosis. Cell. Sep. 4, 1992;70(5):821-8.

Cho et al., Analysis of off-target effects of CRISPR/Cas-derived RNA-guided endonucleases and nickases. Genome Res. Jan. 2014;24(1):132-41. doi: 10.1101/gr.162339.113. Epub Nov. 19, 2013.

Cho et al., Targeted genome engineering in human cells with the Cas9 RNA-guided endonuclease. Nat Biotechnol. Mar. 2013;31(3):230-2. doi: 10.1038/nbt.2507. Epub Jan. 29, 2013.

Christian et al, Targeting G with TAL effectors: a comparison of activities of TALENs constructed with NN and NK repeat variable di-residues. PLoS One. 2012;7(9):e45383. doi: 10.1371/journal.pone.0045383. Epub Sep. 24, 2012.

Christian et al., Targeting DNA double-strand breaks with TAL effector nucleases. Genetics. Oct. 2010;186(2):757-61. Doi: 10.1534/genetics.110.120717. Epub Jul. 26, 2010.

Chu et al., Increasing the efficiency of homology-directed repair for CRISPR-Cas9-induced precise gene editing in mammalian cells. Nat Biotech. Feb. 13, 2015;33:543-8.

Chung-Il et al., Artificial control of gene expression in mammalian cells by modulating RNA interference through aptamer-small molecule interaction. RNA. May 2006;12(5):710-6. Epub Apr. 10, 2006.

Chylinski et al., The tracrRNA and Cas9 families of type II CRISPR-Cas immunity systems. RNA Biol. May 2013;10(5):726-37. doi: 10.4161/rna.24321. Epub Apr. 5, 2013.

Cole-Strauss et al., Correction of the mutation responsible for sickle cell anemia by an RNA-DNA oligonucleotide. Science. Sep. 6, 1996;273(5280):1386-9.

Cong et al., Multiplex genome engineering using CRISPR/Cas systems. Science. Feb. 15, 2013;339(6121):819-23. doi: 10.1126/science.1231143. Epub Jan. 3, 2013.

Conticello, The AID/APOBEC family of nucleic acid mutators. Genome Biol. 2008;9(6):229. doi: 10.1186/gb-2008-9-6-229. Epub Jun. 17, 2008.

Cox et al., Conditional gene expression in the mouse inner ear using Cre-loxP. J Assoc Res Otolaryngol. Jun. 2012;13(3):295-322. doi: 10.1007/s10162-012-0324-5. Epub Apr. 24, 2012.

Cox et al., Therapeutic genome editing: prospects and challenges. Nat Med. Feb. 2015;21(2):121-31. doi: 10.1038/nm.3793.

Cradick et al., CRISPR/Cas9 systems targeting β-globin and CCR5 genes have substantial off-target activity. Nucleic Acids Res. Nov. 1, 2013;41(20):9584-92. doi: 10.1093/nar/gkt714. Epub Aug. 11, 2013.

Cradick et al., ZFN-site searches genomes for zinc finger nuclease target sites and off-target sites. BMC Bioinformatics. May 13, 2011;12:152. doi: 10.1186/1471-2105-12-152.

Cradick et al., Zinc-finger nucleases as a novel therapeutic strategy for targeting hepatitis B virus DNAs. Mol Ther. May 2010;18(5):947-54. Doi: 10.1038/mt.2010.20. Epub Feb. 16, 2010.

Cui et al., Targeted integration in rat and mouse embryos with zinc-finger nucleases. Nat Biotechnol. Jan. 2011;29(1):64-7. Doi: 10.1038/nbt.1731. Epub Dec. 12, 2010.

Cunningham et al., Ensembl 2015. Nucleic Acids Res. Jan. 2015;43(Database issue):D662-9. doi: 10.1093/nar/gku1010. Epub Oct. 28, 2014.

Dahlem et al., Simple methods for generating and detecting locus-specific mutations induced with TALENs in the zebrafish genome. PLoS Genet. 2012;8(8):e1002861. doi: 10.1371/journal.pgen.1002861. Epub Aug. 16, 2012.

Davis et al., Small molecule-triggered Cas9 protein with improved genome-editing specificity. Nat Chem Biol. May 2015;11(5):316-8. doi: 10.1038/nchembio.1793. Epub Apr. 6, 2015.

De Souza, Primer: genome editing with engineered nucleases. Nat Methods. Jan. 2012;9(1):27.

Deltcheva et al., CRISPR RNA maturation by trans-encoded small RNA and host factor RNase III. Nature. Mar. 31, 2011;471(7340):602-7. doi: 10.1038/nature09886.

Dicarlo et al., Genome engineering in *Saccharomyces cerevisiae* using CRISPR-Cas systems. Nucleic Acids Research Apr. 2013;41(7):4336-43.

Ding et al., A TALEN genome-editing system for generating human stem cell-based disease models. Cell Stem Cell. Feb. 7, 2013;12(2):238-51. Doi: 10.1016/j.stem.2012.11.011. Epub Dec. 13, 2012.

Dormiani et al., Long-term and efficient expression of human β-globin gene in a hematopoietic cell line using a new site-specific integrating non-viral system. Gene Ther. Aug. 2015;22(8):663-74. doi: 10.1038/gt.2015.30. Epub Apr. 1, 2015.

Doudna et al., Genome editing. The new frontier of genome engineering with CRISPR-Cas9. Science. Nov. 28, 2014;346(6213):1258096. doi: 10.1126/science.1258096.

(56) References Cited

OTHER PUBLICATIONS

Doyon et al., Heritable targeted gene disruption in zebrafish using designed zinc-finger nucleases. Nat Biotechnol. Jun. 2008;26(6):702-8. Doi: 10.1038/nbt1409. Epub May 25, 2008.
Dunaime, Breakthrough method means CRISPR just got a lot more relevant to human health. The Verge. Apr. 20, 2016. http://www.theverge.com/2016/4/20/11450262/crispr-base-editing-single-nucleotides-dna-gene-liu-harvard.
East-Seletsky et al., Two distinct RNase activities of CRISPR-C2c2 enable guide-RNA processing and RNA detection. Nature Oct. 2016;538(7624):270-3.
Eltoukhy et al., Nucleic acid-mediated intracellular protein delivery by lipid-like nanoparticles. Biomaterials. Aug. 2014;35(24):6454-61. doi: 10.1016/j.biomaterials.2014.04.014. Epub May 13, 2014.
Esvelt et al., Genome-scale engineering for systems and synthetic biology. Mol Syst Biol. 2013;9:641. doi: 10.1038/msb.2012.66.
Esvelt et al., Orthogonal Cas9 proteins for RNA-guided gene regulation and editing. Nat Methods. Nov. 2013;10(11):1116-21. doi: 10.1038/nmeth.2681. Epub Sep. 29, 2013.
Fine et al., Trans-spliced Cas9 allows cleavage of HBB and CCR5 genes in human cells using compact expression cassettes. Scientific Reports 2015;5(1):Article No. 10777. doi:10.1038/srep10777. With Supplementary Information.
Fonfara et al., Phylogeny of Cas9 determines functional exchangeability of dual-RNA and Cas9 among orthologous type II CRISPR-Cas systems. Nucleic Acids Res. Feb. 2014;42(4):2577-90. doi: 10.1093/nar/gkt1074. Epub Nov. 22, 2013.
Freshney, Culture of Animal Cells. A Manual of Basic Technique. Alan R. Liss, Inc. New York. 1983;4.
Fu et al., Improving CRISPR-Cas nuclease specificity using truncated guide RNAs. Nat Biotechnol. Mar. 2014;32(3):279-84. doi: 10.1038/nbt.2808. Epub Jan. 26, 2014.
Fu et al., High-frequency off-target mutagenesis induced by CRISPR-Cas nucleases in human cells. Nat Biotechnol. Sep. 2013;31(9):822-6. doi: 10.1038/nbt.2623. Epub Jun. 23, 2013.
Fuchs et al., Polyarginine as a multifunctional fusion tag. Protein Sci. Jun. 2005;14(6):1538-44.
Fujisawa et al., Disease-associated mutations in CIAS1 induce cathepsin B-dependent rapid cell death of human THP-1 monocytic cells. Blood. Apr. 1, 2007;109(7):2903-11.
Fung et al., Repair at single targeted DNA double-strand breaks in pluripotent and differentiated human cells. PLoS One. 2011;6(5):e20514. doi: 10.1371/journal.pone.0020514. Epub May 25, 2011.
Gaj et al., A comprehensive approach to zinc-finger recombinase customization enables genomic targeting in human cells. Nucleic Acids Res. Feb. 6, 2013;41(6):3937-46.
Gaj et al., Enhancing the specificity of recombinase-mediated genome engineering through dimer interface redesign. J Am Chem Soc. Apr. 2, 2014;136(13):5047-56. doi: 10.1021/ja4130059. Epub Mar. 20, 2014.
Gaj et al., Expanding the scope of site-specific recombinases for genetic and metabolic engineering. Biotechnol Bioeng. Jan. 2014;111(1):1-15. doi: 10.1002/bit.25096. Epub Sep. 13, 2013.
Gaj et al., ZFN, TALEN, and CRISPR/Cas-based methods for genome engineering. Trends Biotechnol. Jul. 2013;31(7):397-405. doi: 10.1016/j.tibtech.2013.04.004. Epub May 9, 2013.
Gallo et al., A novel pathogenic PSEN1 mutation in a family with Alzheimer's disease: phenotypical and neuropathological features. J Alzheimers Dis. 2011;25(3):425-31. doi: 10.3233/JAD-2011-110185.
Gao et al., DNA-guided genome editing using the Natronobacterium gregoryi Argonaute. Nat Biotechnol. Jul. 2016;34(7):768-73. doi: 10.1038/nbt.3547. Epub May 2, 2016.
Gardlik et al., Vectors and delivery systems in gene therapy. Med Sci Monit. Apr. 2005;11(4):RA110-21. Epub Mar. 24, 2005.
Gasiunas et al., Cas9-crRNA ribonucleoprotein complex mediates specific DNA cleavage for adaptive immunity in bacteria. Proc Natl Acad Sci U S A. Sep. 25, 2012;109(39):E2579-86. Epub Sep. 4, 2012. Supplementary materials included.
Gasiunas et al., RNA-dependent DNA endonuclease Cas9 of the CRISPR system: Holy Grail of genome editing? Trends Microbiol. Nov. 2013;21(11):562-7. doi: 10.1016/j.tim.2013.09.001. Epub Oct. 1, 2013.
Genbank Submission; NIH/NCBI, Accession No. J04623. Kita et al., Apr. 26, 1993. 2 pages.
Genbank Submission; NIH/NCBI, Accession No. NC_002737.1. Ferretti et al., Jun. 27, 2013. 1 page.
Genbank Submission; NIH/NCBI, Accession No. NC_015683.1. Trost et al., Jul. 6, 2013. 1 page.
Genbank Submission; NIH/NCBI, Accession No. NC_016782.1. Trost et al., Jun. 11, 2013. 1 page.
Genbank Submission; NIH/NCBI, Accession No. NC_016786.1. Trost et al., Aug. 28, 2013. 1 page.
Genbank Submission; NIH/NCBI, Accession No. NC_017053.1. Fittipaldi et al., Jul. 6, 2013. 1 page.
Genbank Submission; NIH/NCBI, Accession No. NC_017317.1. Trost et al., Jun. 11, 2013. 1 page.
Genbank Submission; NIH/NCBI, Accession No. NC_017861.1. Heidelberg et al., Jun. 11, 2013. 1 page.
Genbank Submission; NIH/NCBI, Accession No. NC_018010.1. Lucas et al., Jun. 11, 2013. 2 pages.
Genbank Submission; NIH/NCBI, Accession No. NC_018721.1. Feng et al., Jun. 11, 2013. 1 pages.
Genbank Submission; NIH/NCBI, Accession No. NC_021284.1. Ku et al., Jul. 12, 2013. 1 page.
Genbank Submission; NIH/NCBI, Accession No. NC_021314.1. Zhang et al., Jul. 15, 2013. 1 page.
Genbank Submission; NIH/NCBI, Accession No. NC_021846.1. Lo et al., Jul. 22, 2013. 1 page.
Genbank Submission; NIH/NCBI, Accession No. NP_472073.1. Glaser et al., Jun. 27, 2013. 2 pages.
Genbank Submission; NIH/NCBI, Accession No. P42212. Prasher et al., Mar. 19, 2014. 7 pages.
Genbank Submission; NIH/NCBI, Accession No. YP_002342100.1. Bernardini et al., Jun. 10, 2013. 2 pages.
Genbank Submission; NIH/NCBI, Accession No. YP_002344900.1. Gundogdu et al., Mar. 19, 2014. 2 pages.
Genbank Submission; NIH/NCBI, Accession No. YP_820832.1. Makarova et al., Aug. 27, 2013. 2 pages.
Gerber et al., RNA editing by base deamination: more enzymes, more targets, new mysteries. Trends Biochem Sci. Jun. 2001;26(6):376-84.
Gersbach et al., Directed evolution of recombinase specificity by split gene reassembly. Nucleic Acids Res. Jul. 2010;38(12):4198-206. doi: 10.1093/nar/gkq125. Epub Mar. 1, 2010.
Gersbach et al., Targeted plasmid integration into the human genome by an engineered zinc-finger recombinase. Nucleic Acids Res. Sep. 1, 2011;39(17):7868-78. doi: 10.1093/nar/gkr421. Epub Jun. 7, 2011.
Gilbert et al., CRISPR-mediated modular RNA-guided regulation of transcription in eukaryotes. Cell. 2013 154(2):442-51.
Gilleron et al., Image-based analysis of lipid nanoparticle-mediated siRNA delivery, intracellular trafficking and endosomal escape. Nat Biotechnol. Jul. 2013;31(7):638-46. doi: 10.1038/nbt.2612. Epub Jun. 23, 2013.
Gonzalez et al., An iCRISPR platform for rapid, multiplexable, and inducible genome editing in human pluripotent stem cells. Cell Stem Cell. Aug. 7, 2014;15(2):215-26. doi: 10.1016/j.stem.2014.05.018. Epub Jun. 12, 2014.
Guilinger et al., Broad specificity profiling of TALENs results in engineered nucleases with improved DNA-cleavage specificity. Nat Methods. Apr. 2014;11(4):429-35. doi: 10.1038/nmeth.2845. Epub Feb. 16, 2014.
Guilinger et al., Fusion of catalytically inactive Cas9 to FokI nuclease improves the specificity of genome modification. Nat Biotechnol. Jun. 2014;32(6):577-82. doi: 10.1038/nbt.2909. Epub Apr. 25, 2014.
Guo et al., Protein tolerance to random amino acid change. Proc Natl Acad Sci U S A. Jun. 22, 2004;101(25):9205-10. Epub Jun. 14, 2004.

(56) References Cited

OTHER PUBLICATIONS

Hale et al., RNA-guided Rna cleavage by a CRISPR RNA-Cas protein complex. Cell. Nov. 25, 2009;139(5):945-56. doi: 10.1016/j.cell.2009.07.040.

Han, New CRISPR/Cas9-based Tech Edits Single Nucleotides Without Breaking DNA. Genome Web, Apr. 20, 2016. https://www.genomeweb.com/gene-silencinggene-editing/new-crisprcas9-based-tech-edits-single-nucleotides-without-breaking-dna.

Harris et al., RNA editing enzyme APOBEC1 and some of its homologs can act as DNA mutators. Mol Cell. Nov. 2002;10(5):1247-53.

Hartung et al., Correction of metabolic, craniofacial, and neurologic abnormalities in MPS I mice treated at birth with adeno-associated virus vector transducing the human alpha-L-iduronidase gene. Mol Ther. Jun. 2004;9(6):866-75.

Hasadsri et al., Functional protein delivery into neurons using polymeric nanoparticles. J Biol Chem. Mar. 13, 2009;284(11):6972-81. doi: 10.1074/jbc.M805956200. Epub Jan. 7, 2009.

Hess et al., Directed evolution using dCas9-targeted somatic hypermutation in mammalian cells. Nat Methods. Dec. 2016;13(12):1036-1042. doi: 10.1038/nmeth.4038. Epub Oct. 31, 2016.

Hill et al., Functional analysis of conserved histidines in ADP-glucose pyrophosphorylase from *Escherichia coli*.Biochem Biophys Res Commun. Mar. 17, 1998;244(2):573-7.

Hilton et al., Enabling functional genomics with genome engineering. Genome Res. Oct. 2015;25(10):1442-55. doi: 10.1101/gr.190124.115.

Hockemeyer et al., Efficient targeting of expressed and silent genes in human ESCs and iPSCs using zinc-finger nucleases. Nat Biotechnol. Sep. 2009;27(9):851-7. doi: 10.1038/nbt.1562. Epub Aug. 13, 2009.

Hockemeyer et al., Genetic engineering of human pluripotent cells using TALE nucleases. Nat Biotechnol. Jul. 7, 2011;29(8):731-4. doi: 10.1038/nbt.1927.

Holden et al., Crystal structure of the anti-viral APOBEC3G catalytic domain and functional implications. Nature. Nov. 6, 2008;456(7218):121-4. doi: 10.1038/nature07357. Epub Oct. 12, 2008.

Hondares et al., Peroxisome Proliferator-activated Receptor α (PPARα) Induces PPARγ Coactivator 1α (PGC-1α) Gene Expression and Contributes to Thermogenic Activation of Brown Fat. J Biol. Chem Oct. 2011; 286(50):43112-22. doi: 10.1074/jbc.M111.252775.

Horvath et al., CRISPR/Cas, the immune system of bacteria and archaea. Science. Jan. 8, 2010;327(5962):167-70. doi: 10.1126/science.1179555.

Hou et al., Efficient genome engineering in human pluripotent stem cells using Cas9 from Neisseria meningitidis. Proc Natl Acad Sci U S A. Sep. 24, 2013;110(39):15644-9. doi: 10.1073/pnas.1313587110. Epub Aug. 12, 2013.

Houdebine, The methods to generate transgenic animals and to control transgene expression. J Biotechnol. Sep. 25, 2002;98(2-3):145-60.

Hower et al., Shape-based peak identification for ChIP-Seq. BMC Bioinformatics. Jan. 12, 2011;12:15. doi: 10.1186/1471-2105-12-15.

Hsu et al., DNA targeting specificity of RNA-guided Cas9 nucleases. Nat Biotechnol. Sep. 2013;31(9):827-32. doi: 10.1038/nbt.2647. Epub Jul. 21, 2013.

Huang et al., Heritable gene targeting in zebrafish using customized TALENs. Nat Biotechnol. Aug. 5, 2011;29(8):699-700. doi: 10.1038/nbt.1939.

Hurt et al., Highly specific zinc finger proteins obtained by directed domain shuffling and cell-based selection. Proc Natl Acad Sci U S A. Oct. 14, 2003;100(21):12271-6. Epub Oct. 3, 2003.

Hwang et al., Efficient genome editing in zebrafish using a CRISPR-Cas system. Nat Biotechnol. Mar. 2013;31(3):227-9. doi: 10.1038/nbt.2501. Epub Jan. 29, 2013.

Ikediobi et al., Mutation analysis of 24 known cancer genes in the NCI-60 cell line set. Mol Cancer Ther. Nov. 2006;5(11):2606-12. Epub Nov. 6, 2006.

International Preliminary Report on Patentability for PCT/US2012/047778, dated Feb. 6, 2014.

International Preliminary Report on patentability for PCT/US2014/050283, dated Feb. 18, 2016.

International Preliminary Report on Patentability for PCT/US2014/052231, dated Mar. 3, 2016.

International Preliminary Report on Patentability for PCT/US2014/054247, dated Mar. 17, 2016.

International Preliminary Report on Patentability for PCT/US2014/054291, dated Mar. 17, 2016.

International Preliminary Report on Patentability for PCT/US2014/070038, dated Jun. 23, 2016.

International Preliminary Report on Patentability for PCT/US2015/042770, dated Dec. 19, 2016.

International Preliminary Report on Patentability for PCT/US2015/058479, dated May 11, 2017.

International Preliminary Report on Patentability or PCT/US2014/054252, dated Mar. 17, 2016.

International Search Report and Written Opinion for PCT/US2012/047778, dated May 30, 2013.

International Search Report and Written Opinion for PCT/US2014/050283, dated Nov. 6, 2014.

International Search Report and Written Opinion for PCT/US2014/052231, dated Dec. 4, 2014.

International Search Report and Written Opinion for PCT/US2014/052231, dated Jan. 30, 2015 (Corrected Version).

International Search Report and Written Opinion for PCT/US2014/054247, dated Mar. 27, 2015.

International Search Report and Written Opinion for PCT/US2014/054252, dated Mar. 5, 2015.

International Search Report and Written Opinion for PCT/US2014/054291, dated Mar. 27, 2015.

International Search Report and Written Opinion for PCT/US2014/070038, dated Apr. 14, 2015.

International Search Report and Written Opinion for PCT/US2015/042770, dated Feb. 23, 2016.

International Search Report and Written Opinion for PCT/US2015/058479, dated Feb. 11, 2016.

International Search Report and Written Opinion for PCT/US2016/044546, dated Dec. 28, 2016.

International Search Report and Written Opinion for PCT/US2016/058344, dated Apr. 20, 2017.

International Search Report and Written Opinion for PCT/US2017/045381, dated Oct. 26, 2017.

International Search Report and Written Opinion for PCT/US2017/046144, dated Oct. 10, 2017.

International Search Report and Written Opinion for PCT/US2017/056671, dated Feb. 20, 2018.

International Search Report and Written Opinion for PCT/US2017/48390, dated Jan. 9, 2018.

International Search Report for PCT/US2013/032589, dated Jul. 26, 2013.

Invitation to Pay Additional Fees for PCT/US2014/054291, dated Dec. 18, 2014.

Invitation to Pay Additional Fees for PCT/US2016/058344, dated Mar. 1, 2017.

Invitation to Pay Additional Fees for PCT/US2017/056671, dated Dec. 21, 2017.

Invitation to Pay Additional Fees for PCT/US2017/48390, dated Nov. 7, 2017.

Irrthum et al., Congenital hereditary lymphedema caused by a mutation that inactivates VEGFR3 tyrosine kinase. Am J Hum Genet. Aug. 2000;67(2):295-301. Epub Jun. 9, 2000.

Jamieson et al., Drug discovery with engineered zinc-finger proteins. Nat Rev Drug Discov. May 2003;2(5):361-8.

Jansen et al., Backbone and nucleobase contacts to glucosamine-6-phosphate in the glmS ribozyme. Nat Struct Mol Biol. Jun. 2006;13(6):517-23. Epub May 14, 2006.

Jenkins et al., Comparison of a preQ1 riboswitch aptamer in metabolite-bound and free states with implications for gene regulation. J Biol Chem. Jul. 15, 2011;286(28):24626-37. doi: 10.1074/jbc.M111.230375. Epub May 18, 2011.

(56) References Cited

OTHER PUBLICATIONS

Jiang et al., RNA-guided editing of bacterial genomes using CRISPR-Cas systems. Nat Biotechnol. Mar. 2013;31(3):233-9. doi: 10.1038/nbt.2508. Epub Jan. 29, 2013.

Jiang et al., Structures of a CRISPR-Cas9 R-loop complex primed for DNA cleavage. Science. Feb. 19, 2016;351(6275):867-71. doi: 10.1126/science.aad8282. Epub Jan. 14, 2016.

Jinek et al., A programmable dual-RNA-guided DNA endonuclease in adaptive bacterial immunity. Science. Aug. 17, 2012;337(6096):816-21. doi: 10.1126/science.1225829. Epub Jun. 28, 2012.

Jinek et al., RNA-programmed genome editing in human cells. Elife. Jan. 29, 2013;2:e00471. doi: 10.7554/eLife.00471.

Jinek et al., Structures of Cas9 endonucleases reveal RNA-mediated conformational activation. Science. Mar. 14, 2014;343(6176):1247997. doi: 10.1126/science.1247997. Epub Feb. 6, 2014.

Jore et al., Structural basis for CRISPR RNA-guided DNA recognition by Cascade. Nat Struct Mol Biol. May 2011;18(5):529-36. doi: 10.1038/nsmb.2019. Epub Apr. 3, 2011.

Joung et al., TALENs: a widely applicable technology for targeted genome editing. Nat Rev Mol Cell Biol. Jan. 2013;14(1):49-55. doi: 10.1038/nrm3486. Epub Nov. 21, 2012.

Kaiser et al., Gene therapy. Putting the fingers on gene repair. Science. Dec. 23, 2005;310(5756):1894-6.

Kandavelou et al., Targeted manipulation of mammalian genomes using designed zinc finger nucleases. Biochem Biophys Res Commun. Oct. 9, 2009;388(1):56-61. doi: 10.1016/j.bbrc.2009.07.112. Epub Jul. 25, 2009.

Kappel et al., Regulating gene expression in transgenic animals. Curr Opin Biotechnol. Oct. 1992;3(5):548-53.

Karpenshif et al., From yeast to mammals: recent advances in genetic control of homologous recombination. DNA Repair (Amst). Oct. 1, 2012;11(10):781-8. doi: 10.1016/j.dnarep.2012.07.001. Epub Aug. 11, 2012. Review.

Karpinsky et al., Directed evolution of a recombinase that excises the provirus of most HIV-1 primary isolates with high specificity. Nat Biotechnol. Apr. 2016;34(4):401-9. doi: 10.1038/nbt.3467. Epub Feb. 22, 2016.

Kaya et al., A bacterial Argonaute with noncanonical guide RNA specificity. Proc. Natl. Acad. Sci. USA Apr. 2016;113(15):4057-62.

Kellendonk et al., Regulation of Cre recombinase activity by the synthetic steroid RU 486. Nucleic Acids Res. Apr. 15, 1996;24(8):1404-11.

Kim et al., A library of TAL effector nucleases spanning the human genome. Nat Biotechnol. Mar. 2013;31(3):251-8. Doi: 10.1038/nbt.2517. Epub Feb. 17, 2013.

Kim et al., Genome-wide target specificities of CRISPR RNA-guided programmable deaminases. Nat Biotechnol. May 2017;35(5):475-480. doi: 10.1038/nbt.3852. Epub Apr. 10, 2017.

Kim et al., Highly efficient RNA-guided base editing in mouse embryos. Nat Biotechnol. May 2017;35(5):435-437. doi: 10.1038/nbt.3816. Epub Feb. 27, 2017.

Kim et al., Highly efficient RNA-guided genome editing in human cells via delivery of purified Cas9 ribonucleoproteins. Genome Res. Jun. 2014;24(6):1012-9. doi: 10.1101/gr.171322.113. Epub Apr. 2, 2014.

Kim et al., Increasing the genome-targeting scope and precision of base editing with engineered Cas9-cytidine deaminase fusions. Nat Biotechnol. Apr. 2017;35(4):371-376. doi: 10.1038/nbt.3803. Epub Feb. 13, 2017.

Kim et al., TALENs and ZFNs are associated with different mutationsignatures. Nat Methods. Mar. 2013;10(3):185. doi: 10.1038/nmeth.2364. Epub Feb. 10, 2013.

Kim et al., Targeted genome editing in human cells with zinc finger nucleases constructed via modular assembly. Genome Res. Jul. 2009;19(7):1279-88. doi: 10.1101/gr.089417.108. Epub May 21, 2009.

Kim et al., The role of apolipoprotein E in Alzheimer's disease. Neuron. Aug. 13, 2009;63(3):287-303. doi: 10.1016/j.neuron.2009.06.026.

Kim et al., Transcriptional repression by zinc finger peptides. Exploring the potential for applications in gene therapy. J Biol Chem. Nov. 21, 1997;272(47):29795-800.

Kitamura et al., Uracil DNA glycosylase counteracts APOBEC3G-induced hypermutation of hepatitis B viral genomes: excision repair of covalently closed circular DNA. PLoS Pathog. 2013;9(5):e1003361. doi: 10.1371/journal.ppat.1003361. Epub May 16, 2013.

Klauser et al., An engineered small RNA-mediated genetic switch based on a ribozyme expression platform. Nucleic Acids Res. May 1, 2013;41(10):5542-52. doi: 10.1093/nar/gkt253. Epub Apr. 12, 2013.

Kleinstiver et al., Broadening the targeting range of *Staphylococcus aureus* CRISPR-Cas9 by modifying PAM recognition. Nat Biotechnol. Dec. 2015;33(12):1293-1298. doi: 10.1038/nbt.3404. Epub Nov. 2, 2015.

Kleinstiver et al., Engineered CRISPR-Cas9 nucleases with altered PAM specificities. Nature. Jul. 23, 2015;523(7561):481-5. doi: 10.1038/nature14592. Epub Jun. 22, 2015.

Kleinstiver et al., High-fidelity CRISPR-Cas9 nucleases with no detectable genome-wide off-target effects. Nature. Jan. 28, 2016;529(7587):490-5. doi: 10.1038/nature16526. Epub Jan. 6, 2016.

Kleinstiver et al., Monomeric site-specific nucleases for genome editing. Proc Natl Acad Sci U S A. May 22, 2012;109(21):8061-6. doi: 10.1073/pnas.1117984109. Epub May 7, 2012.

Klippel et al., Isolation and characterization of unusual gin mutants. EMBO J. Dec. 1, 1988;7(12):3983-9.

Klippel et al., The DNA invertase Gin of phage Mu: formation of a covalent complex with DNA via a phosphoserine at amino acid position 9. EMBO J. Apr. 1988;7(4):1229-37.

Komor et al., Programmable editing of a target base in genomic DNA without double-stranded DNA cleavage. Nature. Apr. 20, 2016;533(7603):420-4. doi: 10.1038/nature17946.

Kumar et al., Structural and functional consequences of the mutation of a conserved arginine residue in alphaA and alphaB crystallins. J Biol Chem. Aug. 20, 1999;274(34):24137-41.

Kundu et al., Leucine to proline substitution by SNP at position 197 in Caspase-9 gene expression leads to neuroblastoma: a bioinformatics analysis. 3 Biotech. 2013; 3:225-34.

Kuscu et al., CRISPR-STOP: gene silencing through base-editing-induced nonsense mutations. Nat Methods. Jul. 2017;14(7):710-712. doi: 10.1038/nmeth.4327. Epub Jun. 5, 2017.

Kuscu et al., Genome-wide analysis reveals characteristics of off-target sites bound by the Cas9 endonuclease. Nat Biotechnol. Jul. 2014;32(7):677-83. doi: 10.1038/nbt.2916. Epub May 18, 2014.

Landrum et al., ClinVar: public archive of interpretations of clinically relevant variants. Nucleic Acids Res. Jan. 4, 2016;44(D1):D862-8. doi: 10.1093/nar/gkv1222. Epub Nov. 17, 2015.

Larson et al., CRISPR interference (CRISPRi) for sequence-specific control of gene expression. Nat Protoc. Nov. 2013;8(11):2180-96. doi: 10.1038/nprot.2013.132. Epub Oct. 17, 2013.

Lau et al., Molecular basis for discriminating between normal and damaged bases by the human alkyladenine glycosylase, AAG. Proc Natl Acad Sci U S A. Dec. 5, 2000;97(25):13573-8.

Lavergne et al., Defects in type IIA von Willebrand disease: a cysteine 509 to arginine substitution in the mature von Willebrand factor disrupts a disulphide loop involved in the interaction with platelet glycoprotein Ib-Ix. Br J Haematol. Sep. 1992;82(1):66-72.

Lawrence et al., Supercharging proteins can impart unusual resilience. J Am Chem Soc. Aug. 22, 2007;129(33):10110-2. Epub Aug. 1, 2007.

Lazar et al., Transforming growth factor alpha: mutation of aspartic acid 47 and leucine 48 results in different biological activities. Mol Cell Biol. Mar. 1988;8(3):1247-52.

Ledford, Gene-editing hack yields pinpoint precision. Nature, Apr. 20, 2016. http://www.nature.com/news/gene-editing-hack-yields-pinpoint-precision-1.19773.

Lee et al., A chimeric thyroid hormone receptor constitutively bound to DNA requires retinoid X receptor for hormone-dependent transcriptional activation in yeast. Mol Endocrinol. Sep. 1994;8(9):1245-52.

(56) References Cited

OTHER PUBLICATIONS

Lee et al., PIK3CA gene is frequently mutated in breast carcinomas and hepatocellular carcinomas. Oncogene. Feb. 17, 2005;24(8):1477-80.

Lee et al., Recognition of liposomes by cells: in vitro binding and endocytosis mediated by specific lipid headgroups and surface charge density. Biochim Biophys Acta. Jan. 31, 1992;1103(2):185-97.

Lei et al., Efficient targeted gene disruption in Xenopus embryos using engineered transcription activator-like effector nucleases (TALENs). Proc Natl Acad Sci U S A. Oct. 23, 2012;109(43):17484-9. Doi: 10.1073/pnas.1215421109. Epub Oct. 8, 2012.

Lenk et al., Pathogenic mechanism of the FIG4 mutation responsible for Charcot-Marie-Tooth disease CMT4J. PLoS Genet. Jun. 2011;7(6):e1002104. doi: 10.1371/journal.pgen.1002104. Epub Jun. 2, 2011.

Lewis et al., A serum-resistant cytofectin for cellular delivery of antisense oligodeoxynucleotides and plasmid DNA. Proc Natl Acad Sci U S A. Apr. 16, 1996;93(8):3176-81.

Lewis et al., Codon 129 polymorphism of the human prion protein influences the kinetics of amyloid formation. J Gen Virol. Aug. 2006;87(Pt 8):2443-9.

Li et al., Current approaches for engineering proteins with diverse biological properties. Adv Exp Med Biol. 2007;620:18-33.

Li et al., Generation of Targeted Point Mutations in Rice by a Modified CRISPR/Cas9 System. Mol Plant. Mar. 6, 2017;10(3):526-529. doi: 10.1016/j.molp.2016.12.001. Epub Dec. 8, 2016.

Li et al., Highly efficient and precise base editing in discarded human tripronuclear embryos. Protein Cell. Aug. 19, 2017. doi: 10.1007/s13238-017-0458-7. [Epub ahead of print].

Li et al., Modularly assembled designer TAL effector nucleases for targeted gene knockout and gene replacement in eukaryotes. Nucleic Acids Res. Aug. 2011;39(14):6315-25. doi: 10.1093/nar/gkr188. Epub Mar. 31, 2011.

Li et al., TAL nucleases (TALNs): hybrid proteins composed of TAL effectors and FokI DNA-cleavage domain. Nucleic Acids Res. Jan. 2011;39(1):359-72. doi: 10.1093/nar/gkq704. Epub Aug. 10, 2010.

Lin et al., Enhanced homology-directed human genome engineering by controlled timing of CRISPR/Cas9 delivery. Elife. Dec. 15, 2014;3:e04766. doi: 10.7554/eLife.04766.

Liu et al., C2c1-sgRNA Complex Structure Reveals RNA-Guided DNA Cleavage Mechanism. Molecular Cell Jan. 2017;65(2):310-22.

Liu et al., Apolipoprotein E and Alzheimer disease: risk, mechanisms and therapy. Nat Rev Neurol. Feb. 2013;9(2):106-18. doi: 10.1038/nrneurol.2012.263. Epub Jan. 8, 2013.

Liu et al., Cell-penetrating peptide-mediated delivery of TALEN proteins via bioconjugation for genome engineering. PLoS One. Jan. 20, 2014;9(1):e85755. doi: 10.1371/journal.pone.0085755. eCollection 2014.

Liu et al., Design of polydactyl zinc-finger proteins for unique addressing within complex genomes. Proc Natl Acad Sci U S A. May 27, 1997;94(11):5525-30.

Liu et al., Fast Colorimetric Sensing of Adenosine and Cocaine Based on a General Sensor Design Involving Aptamers and Nanoparticles. Angew Chem. 2006;118(1):96-100.

Lombardo et al., Gene editing in human stem cells using zinc finger nucleases and integrase-defective lentiviral vector delivery. Nat Biotechnol. Nov. 2007;25(11):1298-306. Epub Oct. 28, 2007.

Losey et al., Crystal structure of *Staphylococcus sureus* tRNA adenosine deaminase tadA in complex with RNA. Nature Struct. Mol. Biol. Feb. 2006;13(2):153-9.

Lu et al., Precise Editing of a Target Base in the Rice Genome Using a Modified CRISPR/Cas9 System. Mol Plant. Mar. 6, 2017;10(3):523-525. doi: 10.1016/j.molp.2016.11.013. Epub Dec. 6, 2016.

Lundberg et al., Delivery of short interfering RNA using endosomolytic cell-penetrating peptides. FASEB J. Sep. 2007;21(11):2664-71. Epub Apr. 26, 2007.

Lundquist et al., Site-directed mutagenesis and characterization of uracil-DNA glycosylase inhibitor protein. Role of specific carboxylic amino acids in complex formation with *Escherichia coli* uracil-DNA glycosylase. J Biol Chem. Aug. 22, 1997;272(34):21408-19.

Lyons et al., Efficient Recognition of an Unpaired Lesion by a DNA Repair Glycosylase. J. Am. Chem. Soc., 2009;131(49):17742-3. Doi: 10.1021/ja908378y.

Ma et al., Targeted AID-mediated mutagenesis (TAM) enables efficient genomic diversification in mammalian cells. Nature Methods. Oct. 2016;13:1029-35. doi:10.1038/nmeth.4027.

Maeder et al., CRISPR RNA-guided activation of endogenous human genes. Nat Methods. Oct. 2013;10(10):977-9. doi: 10.1038/nmeth.2598. Epub Jul. 25, 2013.

Maeder et al., Rapid "open-source" engineering of customized zinc-finger nucleases for highly efficient gene modification. Mol Cell. Jul. 25, 2008;31(2):294-301. doi:10.1016/j.molce1.2008.06.016.

Maeder et al., Robust, synergistic regulation of human gene expression using TALE activators. Nat Methods. Mar. 2013;10(3):243-5. doi: 10.1038/nmeth.2366. Epub Feb. 10, 2013.

Mahfouz et al., De novo-engineered transcription activator-like effector (TALE) hybrid nuclease with novel DNA binding specificity creates double-strand breaks. Proc Natl Acad Sci U S A. Feb. 8, 2011;108(6):2623-8. doi: 10.1073/pnas.1019533108. Epub Jan. 24, 2011.

Makarova et al., Prokaryotic homologs of Argonaute proteins are predicted to function as key components of a novel system of defense against mobile genetic elements. Biology Direct 2009;4:29.

Mali et al., Cas9 as a versatile tool for engineering biology. Nat Methods. Oct. 2013;10(10):957-63. doi: 10.1038/nmeth.2649.

Mali et al., CAS9 transcriptional activators for target specificity screening and paired nickases for cooperative genome engineering. Nat Biotechnol. Sep. 2013;31(9):833-8. doi: 10.1038/nbt.2675. Epub Aug. 1, 2013.

Mali et al., RNA-guided human genome engineering via Cas9. Science. Feb. 15, 2013;339(6121):823-6. doi: 10.1126/science.1232033. Epub Jan. 3, 2013.

Mani et al., Design, engineering, and characterization of zinc finger nucleases. Biochem Biophys Res Commun. Sep. 23, 2005;335(2):447-57.

Marioni et al., DNA methylation age of blood predicts all-cause mortality in later life. Genome Biol. Jan. 30, 2015;16:25. doi: 10.1186/s13059-015-0584-6.

Maruyama et al., Increasing the efficiency of precise genome editing with CRISPR-Cas9 by inhibition of nonhomologous end joining. Nat Biotechnol. May 2015;33(5):538-42. doi: 10.1038/nbt.3190. Epub Mar. 23, 2015.

Meng et al., Targeted gene inactivation in zebrafish using engineered zinc-finger nucleases. Nat Biotechnol. Jun. 2008;26(6):695-701. doi: 10.1038/nbt1398. Epub May 25, 2008.

Mercer et al., Chimeric TALE recombinases with programmable DNA sequence specificity. Nucleic Acids Res. Nov. 2012;40(21):11163-72. doi: 10.1093/nar/gks875. Epub Sep. 26, 2012.

Meyer et al., Breathing life into polycations: functionalization with pH-responsive endosomolytic peptides and polyethylene glycol enables siRNA delivery. J Am Chem Soc. Mar. 19, 2008;130(11):3272-3. doi: 10.1021/ja710344v. Epub Feb. 21, 2008.

Midoux et al., Chemical vectors for gene delivery: a current review on polymers, peptides and lipids containing histidine or imidazole as nucleic acids carriers. Br J Pharmacol. May 2009;157(2):166-78. doi: 10.1111/j.1476-5381.2009.00288.x.

Miller et al., A TALE nuclease architecture for efficient genome editing. Nat Biotechnol. Feb. 2011;29(2):143-8. doi:10.1038/nbt.1755. Epub Dec. 22, 2010.

Miller et al., An improved zinc-finger nuclease architecture for highly specific genome editing. Nat Biotechnol. Jul. 2007;25(7):778-85. Epub Jul. 1, 2007.

Minoche et al., Evaluation of genomic high-throughput sequencing data generated on Illumina HiSeq and genome analyzer systems. Genome Biol. Nov. 8, 2011;12(11):R112. doi: 10.1186/gb-2011-12-11-r112.

Minoretti et al., A W148R mutation in the human FOXD4 gene segregating with dilated cardiomyopathy, obsessive-compulsive disorder, and suicidality. Int J Mol Med. Mar. 2007;19(3):369-72.

(56) References Cited

OTHER PUBLICATIONS

Mol et al., Crystal structure of human uracil-DNA glycosylase in complex with a protein inhibitor: protein mimicry of DNA. Cell. Sep. 8, 1995;82(5):701-8.
Moore et al., Improved somatic mutagenesis in zebrafish using transcription activator-like effector nucleases (TALENs). PloS One. 2012;7(5):e37877. Doi: 10.1371/journal.pone.0037877. Epub May 24, 2012.
Morbitzer et al., Assembly of custom TALE-type DNA binding domains by modular cloning. Nucleic Acids Res. Jul. 2011;39(13):5790-9. doi: 10.1093/nar/gkr151. Epub Mar. 18, 2011.
Morris et al., A peptide carrier for the delivery of biologically active proteins into mammalian cells. Nat Biotechnol. Dec. 2001;19(12):1173-6.
Moscou et al., A simple cipher governs DNA recognition by TAL effectors. Science. Dec. 11, 2009;326(5959):1501. doi: 10.1126/science.1178817.
Mullins et al., Transgenesis in nonmurine species. Hypertension. Oct. 1993;22(4):630-3.
Mussolino et al., A novel TALE nuclease scaffold enables high genome editing activity in combination with low toxicity. Nucleic Acids Res. Nov. 2011;39(21):9283-93. Doi: 10.1093/nar/gkr597. Epub Aug. 3, 2011.
Mussolino et al., TALE nucleases: tailored genome engineering made easy. Curr Opin Biotechnol. Oct. 2012;23(5):644-50. doi: 10.1016/j.copbio.2012.01.013. Epub Feb. 17, 2012.
Nahvi et al., Coenzyme B12 riboswitches are widespread genetic control elements in prokaryotes. Nucleic Acids Res. Jan. 2, 2004;32(1):143-50.
Narayanan et al., Clamping down on weak terminal base pairs: oligonucleotides with molecular caps as fidelity-enhancing elements at the 5'- and 3'-terminal residues. Nucleic Acids Res. May 20, 2004;32(9):2901-11. Print 2004.
Navaratnam et al., An overview of cytidine deaminases. Int J Hematol. Apr. 2006;83(3):195-200.
NCBI Reference Sequence: NM_002427.3. Wu et al., May 3, 2014. 5 pages.
Nishida et al., Targeted nucleotide editing using hybrid prokaryotic and vertebrate adaptive immune systems. Science. Sep. 16, 2016;353(6305):1248. pii: aaf8729. doi: 10.1126/science.aaf8729. Epub Aug. 4, 2016.
Nishimasu et al., Crystal structure of Cas9 in complex with guide RNA and target DNA. Cell. Feb. 27, 2014;156(5):935-49. doi: 10.1016/j.cell.2014.02.001. Epub Feb. 13, 2014.
Nomura et al., Synthetic mammalian riboswitches based on guanine aptazyme. Chem Commun (Camb). Jul. 21, 2012;48(57):7215-7. doi: 10.1039/c2cc33140c. Epub Jun. 13, 2012.
Noris et al., A phenylalanine-55 to serine amino-acid substitution in the human glycoprotein IX leucine-rich repeat is associated with Bernard-Soulier syndrome. Br J Haematol. May 1997;97(2):312-20.
O'Connell et al., Programmable RNA recognition and cleavage by CRISPR/Cas9. Nature. Dec. 11, 2014;516(7530):263-6. doi: 10.1038/nature13769. Epub Sep. 28, 2014.
Offord, Advances in Genome Editing. The Scientist, Apr. 20, 2016. http://www.the-scientist.com/?articles.view/articleNo/45903/title/Advances-in-Genome-Editing/.
Osborn et al., TALEN-based gene correction for epidermolysis bullosa. Mol Ther. Jun. 2013;21(6):1151-9. doi: 10.1038/mt.2013.56. Epub Apr. 2, 2013.
Pan et al., Biological and biomedical applications of engineered nucleases. Mol Biotechnol. Sep. 2013;55(1):54-62. doi: 10.1007/s12033-012-9613-9.
Parker et al., Admixture mapping identifies a quantitative trait locus associated with FEV1/FVC in the COPDGene Study. Genet Epidemiol. Nov. 2014;38(7):652-9. doi: 10.1002/gepi.21847. Epub Aug. 11, 2014.
Partial Supplementary European Search Report for Application No. EP 12845790.0, dated Mar. 18, 2015.

Pattanayak et al., Determining the specificities of TALENs, Cas9, and other genome-editing enzymes. Methods Enzymol. 2014;546:47-78. doi: 10.1016/B978-0-12-801185-0.00003-9.
Pattanayak et al., High-throughput profiling of off-target DNA cleavage reveals RNA-programmed Cas9 nuclease specificity. Nat Biotechnol. Sep. 2013;31(9):839-43. doi: 10.1038/nbt.2673. Epub Aug. 11, 2013.
Pattanayak et al., Revealing off-target cleavage specificities of zinc-finger nucleases by in vitro selection. Nat Methods. Aug. 7, 2011;8(9):765-70. doi: 10.1038/nmeth.1670.
Pavletich et al., Zinc finger-DNA recognition: crystal structure of a Zif268-DNA complex at 2.1 A. Science. May 10, 1991;252(5007):809-17.
Pennisi et al., The CRISPR craze. Science. Aug. 23, 2013;341(6148):833-6. doi: 10.1126/science.341.6148.833.
Pennisi et al., The tale of the TALEs. Science. Dec. 14, 2012;338(6113):1408-11. doi: 10.1126/science.338.6113.1408.
Perez et al., Establishment of HIV-1 resistance in CD4+ T cells by genome editing using zinc-finger nucleases. Nat Biotechnol. Jul. 2008;26(7):808-16. Doi: 10.1038/nbt1410. Epub Jun. 29, 2008.
Perez-Pinera et al., Advances in targeted genome editing. Curr Opin Chem Biol. Aug. 2012;16(3-4):268-77. doi: 10.1016/j.cbpa.2012.06.007. Epub Jul. 20, 2012.
Perez-Pinera et al., RNA-guided gene activation by CRISPR-Cas9-based transcription factors. Nat Methods. Oct. 2013;10(10):973-6. doi: 10.1038/nmeth.2600. Epub Jul. 25, 2013.
Petek et al., Frequent endonuclease cleavage at off-target locations in vivo. Mol Ther. May 2010;18(5):983-6. Doi: 10.1038/mt.2010.35. Epub Mar. 9, 2010.
Petolino et al., Editing Plant Genomes: a new era of crop improvement. Plant Biotechnol J. Feb. 2016;14(2):435-6. doi: 10.1111/pbi.12542.
Phillips, The challenge of gene therapy and DNA delivery. J Pharm Pharmacol. Sep. 2001;53(9):1169-74.
Plasterk et al., DNA inversions in the chromosome of *Escherichia coli* and in bacteriophage Mu: relationship to other site-specific recombination systems. Proc Natl Acad Sci U S A. Sep. 1983;80(17):5355-8.
Pluciennik et al., PCNA function in the activation and strand direction of MutLα endonuclease in mismatch repair. Proc Natl Acad Sci U S A. Sep. 14, 2010;107(37):16066-71. doi: 10.1073/pnas.1010662107. Epub Aug. 16, 2010.
Poller et al., A leucine-to-proline substitution causes a defective alpha 1-antichymotrypsin allele associated with familial obstructive lung disease. Genomics. Sep. 1993;17(3):740-3.
Porteus, Design and testing of zinc finger nucleases for use in mammalian cells. Methods Mol Biol. 2008;435:47-61. doi: 10.1007/978-1-59745-232-8_4.
Prashant et al., CAS9 transcriptional activators for target specificity screening and paired nickases for cooperative genome engineering. Nature Biotechnology 2013;31(9):833-8.
Prorocic et al., Zinc-finger recombinase activities in vitro. Nucleic Acids Res. Nov. 2011;39(21):9316-28. doi: 10.1093/nar/gkr652. Epub Aug. 17, 2011.
Proudfoot et al., Zinc finger recombinases with adaptable DNA sequence specificity. PLoS One. Apr. 29, 2011;6(4):e19537. doi: 10.1371/journal.pone.0019537.
Prykhozhij et al., CRISPR multitargeter: a web tool to find common and unique CRISPR single guide RNA targets in a set of similar sequences. PLoS One. Mar. 5, 2015;10(3):e0119372. doi: 10.1371/journal.pone.0119372. eCollection 2015.
Putnam et al., Protein mimicry of DNA from crystal structures of the uracil-DNA glycosylase inhibitor protein and its complex with *Escherichia coli* uracil-DNA glycosylase. J Mol Biol. Mar. 26, 1999;287(2):331-46.
Qi et al., Engineering naturally occurring trans-acting non-coding RNAs to sense molecular signals. Nucleic Acids Res. Jul. 2012;40(12):5775-86. doi: 10.1093/nar/gks168. Epub Mar. 1, 2012.
Qi et al., Repurposing CRISPR as an RNA-guided platform for sequence-specific control of gene expression. Cell. Feb. 28, 2013;152(5):1173-83. doi: 10.1016/j.cell.2013.02.022.

(56) References Cited

OTHER PUBLICATIONS

Ramakrishna et al., Gene disruption by cell-penetrating peptide-mediated delivery of Cas9 protein and guide RNA. Genome Res. Jun. 2014;24(6):1020-7. doi: 10.1101/gr.171264.113. Epub Apr. 2, 2014.
Ramirez et al., Engineered zinc finger nickases induce homology-directed repair with reduced mutagenic effects. Nucleic Acids Res. Jul. 2012;40(12):5560-8. doi: 10.1093/nar/gks179. Epub Feb. 28, 2012.
Ramirez et al., Unexpected failure rates for modular assembly of engineered zinc fingers. Nat Methods. May 2008;5(5):374-5. Doi: 10.1038/nmeth0508-374.
Ran et al., Double nicking by RNA-guided CRISPR Cas9 for enhanced genome editing specificity. Cell. Sep. 12, 2013;154(6):1380-9. doi: 10.1016/j.cell.2013.08.021. Epub Aug. 29, 2013.
Ran et al., Genome engineering using the CRISPR-Cas9 system. Nat Protoc. Nov. 2013;8(11):2281-308. doi: 10.1038/nprot.2013.143. Epub Oct. 24, 2013.
Ran et al., In vivo genome editing using *Staphylococcus aureus* Cas9. Nature. Apr. 9, 2015;520(7546):186-91. doi: 10.1038/nature14299. Epub Apr. 1, 2015.
Rath et al., Fidelity of end joining in mammalian episomes and the impact of Metnase on joint processing. BMC Mol Biol. Mar. 22, 2014;15:6. doi: 10.1186/1471-2199-15-6.
Ravishankar et al., X-ray analysis of a complex of *Escherichia coli* uracil DNA glycosylase (EcUDG) with a proteinaceous inhibitor. The structure elucidation of a prokaryotic UDG. Nuclei Acids Res. 26 (21): 4880-4887 (1998).
Rebuzzini et al., New mammalian cellular systems to study mutations introduced at the break site by non-homologous end-joining. DNA Repair (Amst). May 2, 2005;4(5):546-55.
Rees et al., Improving the DNA specificity and applicability of base editing through protein engineering and protein delivery. Nat Commun. Jun. 6, 2017;8:15790. doi: 10.1038/ncomms15790.
Reyon et al., Flash assembly of TALENs for high-throughput genome editing. Nat Biotechnol. May 2012;30(5):460-5. doi: 10.1038/nbt.2170.
Richardson et al., Enhancing homology-directed genome editing by catalytically active and inactive CRISPR-Cas9 using asymmetric donor DNA. Nat Biotechnol. Mar. 2016;34(3):339-44. doi: 10.1038/nbt.3481. Epub Jan. 20, 2016.
Rong et al., Homologous recombination in human embryonic stem cells using CRISPR/Cas9 nickase and a long DNA donor template. Protein Cell. Apr. 2014;5(4):258-60. doi: 10.1007/s13238014-0032-5.
Rowland et al., Regulatory mutations in Sin recombinase support a structure-based model of the synaptosome. Mol Microbiol. Oct. 2009;74(2):282-98. doi: 10.1111/j.1365-2958.2009.06756.x. Epub Jun. 8, 2009.
Sadelain et al., Safe harbours for the integration of new DNA in the human genome. Nat Rev Cancer. Dec. 1, 2011;12(1):51-8. doi: 10.1038/nrc3179.
Sage et al., Proliferation of functional hair cells in vivo in the absence of the retinoblastoma protein. Science. Feb. 18, 2005;307(5712):1114-8. Epub Jan. 13, 2005.
Samal et al., Cationic polymers and their therapeutic potential. Chem Soc Rev. Nov. 7, 2012;41(21):7147-94. doi: 10.1039/c2cs35094g. Epub Aug. 10, 2012.
Sander et al., CRISPR-Cas systems for editing, regulating and targeting genomes. Nat Biotechnol. Apr. 2014;32(4):347-55. doi: 10.1038/nbt.2842. Epub Mar. 2, 2014.
Sander et al., In silico abstraction of zinc finger nuclease cleavage profiles reveals an expanded landscape of off-target sites. Nucleic Acids Res. Oct. 2013;41(19):e181. doi: 10.1093/nar/gkt716. Epub Aug. 14, 2013.
Sander et al., Targeted gene disruption in somatic zebrafish cells using engineered TALENs. Nat Biotechnol. Aug. 5, 2011;29(8):697-8. doi: 10.1038/nbt.1934.
Sang, Prospects for transgenesis in the chick. Mech Dev. Sep. 2004;121(9):1179-86.
Sanjana et al., A transcription activator-like effector toolbox for genome engineering. Nat Protoc. Jan. 5, 2012;7(1):171-92. doi: 10.1038/nprot.2011.431.
Santiago et al., Targeted gene knockout in mammalian cells by using engineered zinc-finger nucleases. Proc Natl Acad Sci U S A. Apr. 15, 2008;105(15):5809-14. doi: 10.1073/pnas.0800940105. Epub Mar. 21, 2008.
Sapranauskas et al., The *Streptococcus thermophilus* CRISPR/Cas system provides immunity in *Escherichia coli*. Nucleic Acids Res. Nov. 2011;39(21):9275-82. doi: 10.1093/nar/gkr606. Epub Aug. 3, 2011.
Saraconi et al., The RNA editing enzyme APOBEC1 induces somatic mutations and a compatible mutational signature is present in esophageal adenocarcinomas. Genome Biol. Jul. 31, 2014;15(7):417. doi: 10.1186/s13059-014-0417-z.
Sashital et al., Mechanism of foreign DNA selection in a bacterial adaptive immune system. Mol Cell. Jun. 8, 2012;46(5):606-15. doi: 10.1016/j.molcel.2012.03.020. Epub Apr. 19, 2012.
Schriefer et al., Low pressure DNA shearing: a method for random DNA sequence analysis. Nucleic Acids Res. Dec. 25, 1990;18(24):7455-6.
Schwank et al., Functional repair of CFTR by CRISPR/Cas9 in intestinal stem cell organoids of cystic fibrosis patients. Cell Stem Cell. Dec. 5, 2013;13(6):653-8. doi:10.1016/j.stem.2013.11.002.
Schwartz et al., Post-translational enzyme activation in an animal via optimized conditional protein splicing. Nat Chem Biol. Jan. 2007;3(1):50-4. Epub Nov. 26, 2006.
Schwarze et al., In vivo protein transduction: delivery of a biologically active protein into the mouse. Science. Sep. 3, 1999;285(5433):1569-72.
Sclimenti et al., Directed evolution of a recombinase for improved genomic integration at a native human sequence. Nucleic Acids Res. Dec. 15, 2001;29(24):5044-51.
Segal et al., Toward controlling gene expression at will: selection and design of zinc finger domains recognizing each of the 5'-GNN-3' DNA target sequences. Proc Natl Acad Sci U S A. Mar. 16, 1999;96(6):2758-63.
Sells et al., Delivery of protein into cells using polycationic liposomes. Biotechniques. Jul. 1995;19(1):72-6, 78.
Semenova et al., Interference by clustered regularly interspaced short palindromic repeat (CRISPR) RNA is governed by a seed sequence. Proc Natl Acad Sci U S A. Jun. 21, 2011;108(25):10098-103. doi: 10.1073/pnas.1104144108. Epub Jun. 6, 2011.
Semple et al., Rational design of cationic lipids for siRNA delivery. Nat Biotechnol. Feb. 2010;28(2):172-6. doi: 10.1038/nbt.1602. Epub Jan. 17, 2010.
Seripa et al., The missing ApoE allele. Ann Hum Genet. Jul. 2007;71(Pt 4):496-500. Epub Jan. 22, 2007.
Shah et al., Inteins: nature's gift to protein chemists. Chem Sci. 2014;5(1):446-461.
Shah et al., Kinetic control of one-pot trans-splicing reactions by using a wild-type and designed split intein. Angew Chem Int Ed Engl. Jul. 11, 2011;50(29):6511-5. doi: 10.1002/anie.201102909. Epub Jun. 8, 2011.
Shah et al., Target-specific variants of Flp recombinase mediate genome engineering reactions in mammalian cells. FEBS J. Sep. 2015;282(17):3323-33. doi: 10.1111/febs.13345. Epub Jul. 1, 2015.
Shalem et al., Genome-scale CRISPR-Cas9 knockout screening in human cells. Science. Jan. 3, 2014;343(6166):84-7. doi: 10.1126/science.1247005. Epub Dec. 12, 2013.
Sharbeen et al., Ectopic restriction of DNA repair reveals that UNG2 excises AID-induced uracils predominantly or exclusively during G1 phase. J Exp Med. May 7, 2012;209(5):965-74. doi: 10.1084/jem.20112379. Epub Apr. 23, 2012.
Sheridan, First CRISPR-Cas patent opens race to stake out intellectual property. Nat Biotechnol. 2014;32(7):599-601.
Sheridan, Gene therapy finds its niche. Nat Biotechnol. Feb. 2011;29(2):121-8. doi: 10.1038/nbt.1769.
Shimantani et al., Targeted base editing in rice and tomato using a CRISPR-Cas9 cytidine deaminase fusion. Nat Biotechnol. May 2017;35(5):441-443. doi: 10.1038/nbt.3833. Epub Mar. 27, 2017.
Shimojima et al., Spinocerebellar ataxias type 27 derived from a disruption of the fibroblast growth factor 14 gene with mimicking

(56) References Cited

OTHER PUBLICATIONS phenotype of paroxysmal non-kinesigenic dyskinesia. Brain Dev. Mar. 2012;34(3):230-3. doi: 10.1016/j.braindev.2011.04.014. Epub May 19, 2011.
Shmakov et al., Discovery and Functional Characterization of Diverse Class 2 CRISPR Cas Systems. Molecular Cell Nov. 2015;60(3):385-97.
Siebert et al., An improved PCR method for walking in uncloned genomic DNA. Nucleic Acids Res. Mar. 25, 1995;23(6):1087-8.
Simonelli et al., Base excision repair intermediates are mutagenic in mammalian cells. Nucleic Acids Res. Aug. 2, 2005;33(14):4404-11. Print 2005.
Sirk et al., Expanding the zinc-finger recombinase repertoire: directed evolution and mutational analysis of serine recombinase specificity determinants. Nucleic Acids Res. Apr. 2014;42(7):4755-66. doi: 10.1093/nar/gkt1389. Epub Jan. 21, 2014.
Slaymaker et al., Rationally engineered Cas9 nucleases with improved specificity. Science. Jan. 1, 2016;351(6268):84-8. doi: 10.1126/science.aad5227. Epub Dec. 1, 2015.
Smith et al., Expression of a dominant negative retinoic acid receptor γ in Xenopus embryos leads to partial resistance to retinoic acid. Roux Arch Dev Biol. Mar. 1994;203(5):254-265. doi: 10.1007/BF00360521.
Stenglein et al., APOBEC3 proteins mediate the clearance of foreign DNA from human cells. Nat Struct Mol Biol. Feb. 2010;17(2):222-9. doi: 10.1038/nsmb.1744. Epub Jan. 10, 2010.
Sternberg et al., DNA interrogation by the CRISPR RNA-guided endonuclease Cas9. Nature.Mar. 6, 2014;507(7490):62-7. doi: 10.1038/nature13011. Epub Jan. 29, 2014.
Stevens et al., Design of a Split Intein with Exceptional Protein-Splicing Activity. J Am Chem Soc. Feb. 24, 2016;138(7):2162-5. doi: 10.1021/jacs.5b13528. Epub Feb. 8, 2016.
Sun et al., Optimized TAL effector nucleases (TALENs) for use in treatment of sickle cell disease. Mol Biosyst. Apr. 2012;8(4):1255-63. doi: 10.1039/c2mb05461b. Epub Feb. 3, 2012.
Supplementary European Search Report for Application No. EP 12845790.0, dated Oct. 12, 2015.
Swarts et al., Argonaute of the archaeon Pyrococcus furiosus is a DNA-guided nuclease that targets cognate DNA. Nucleic Acids Res. May 26, 2015;43(10):5120-9. doi: 10.1093/nar/gkv415. Epub Apr. 29, 2015.
Swarts et al., DNA-guided DNA interference by a prokaryotic Argonaute. Nature. Mar. 13, 2014;507(7491):258-61. doi: 10.1038/nature12971. Epub Feb. 16, 2014.
Swarts et al., The evolutionary journey of Argonaute proteins. Nat Struct Mol Biol. Sep. 2014;21(9):743-53. doi: 10.1038/nsmb.2879.
Tagalakis et al., Lack of RNA-DNA oligonucleotide (chimeraplast) mutagenic activity in mouse embryos. Mol Reprod Dev. Jun. 2005;71(2):140-4.
Tebas et al., Gene editing of CCR5 in autologous CD4 T cells of persons infected with HIV. N Engl J Med. Mar. 6, 2014;370(10):901-10. doi: 10.1056/NEJMoa1300662.
Tessarollo et al., Targeted mutation in the neurotrophin-3 gene results in loss of muscle sensory neurons. Proc Natl Acad Sci U S A. Dec. 6, 1994;91(25):11844-8.
Tesson et al., Knockout rats generated by embryo microinjection of TALENs. Nat Biotechnol. Aug. 5, 2011;29(8):695-6. doi: 10.1038/nbt.1940.
Thompson et al., Cellular uptake mechanisms and endosomal trafficking of supercharged proteins. Chem Biol. Jul. 27, 2012;19(7):831-43. doi: 10.1016/j.chembiol.2012.06.014.
Thompson et al., Engineering and identifying supercharged proteins for macromolecule delivery into mammalian cells. Methods Enzymol. 2012;503:293-319. doi: 10.1016/B978-0-12-396962-0.00012-4.
Thorpe et al., Functional correction of episomal mutations with short DNA fragments and RNA-DNA oligonucleotides. J Gene Med. Mar.-Apr. 2002;4(2):195-204.
Thyagarajan et al., Mammalian genomes contain active recombinase recognition sites. Gene. Feb. 22, 2000;244(1-2):47-54.

Thyagarajan et al., Site-specific genomic integration in mammalian cells mediated by phage phiC31 integrase. Mol Cell Biol. Jun. 2001;21(12):3926-34.
Tirumalai et al., Recognition of core-type DNA sites by lambda integrase. J Mol Biol. Jun. 12, 1998;279(3):513-27.
Truong et al., Development of an intein-mediated split-Cas9 system for gene therapy. Nucleic Acids Res. Jul. 27, 2015;43(13):6450-8. doi: 10.1093/nar/gkv601. Epub Jun. 16, 2015.
Tsai et al., Dimeric CRISPR RNA-guided FokI nucleases for highly specific genome editing. Nat Biotechnol. Jun. 2014;32(6):569-76. doi: 10.1038/nbt.2908. Epub Apr. 25, 2014.
Tsai et al., Guide-seq enables genome-wide profiling of off-target cleavage by CRISPR-Cas nucleases. Nat Biotechnol. Feb. 2015;33(2):187-97. doi: 10.1038/nbt.3117. Epub Dec. 16, 2014.
Turan et al., Recombinase-mediated cassette exchange (RMCE)—a rapidly-expanding toolbox for targeted genomic modifications. Gene. Feb. 15, 2013;515(1):1-27. doi: 10.1016/j.gene.2012.11.016. Epub Nov. 29, 2012.
Turan et al., Recombinase-mediated cassette exchange (RMCE): traditional concepts and current challenges. J Mol Biol. Mar. 25, 2011;407(2):193-221. doi: 10.1016/j.jmb.2011.01.004. Epub Jan. 15, 2011.
Turan et al., Site-specific recombinases: from tag-and-target- to tag-and-exchange-based genomic modifications. Faseb J. Dec. 2011;25(12):4088-107. doi: 10.1096/fj.11-186940. Epub Sep. 2, 2011. Review.
UNIPROT Submission; UniProt, Accession No. P01011. Last modified Jun. 11, 2014, version 2. 15 pages.
UNIPROT Submission; UniProt, Accession No. P01011. Last modified Sep. 18, 2013, version 2. 15 pages.
UNIPROT Submission; UniProt, Accession No. P04264. Last modified Jun. 11, 2014, version 6. 15 pages.
UNIPROT Submission; UniProt, Accession No. P04275. Last modified Jul. 9, 2014, version 107. 29 pages.
Urnov et al., Genome editing with engineered zinc finger nucleases. Nat Rev Genet. Sep. 2010;11(9):636-46. doi: 10.1038/nrg2842.
Urnov et al., Highly efficient endogenous human gene correction using designed zinc-finger nucleases. Nature. Jun. 2, 2005;435(7042):646-51. Epub Apr. 3, 2005.
Van Duyne et al., Teaching Cre to follow directions. Proc Natl Acad Sci U S A. Jan. 6, 2009;106(1):4-5. doi: 10.1073/pnas.0811624106. Epub Dec. 31, 2008.
Van Swieten et al., A mutation in the fibroblast growth factor 14 gene is associated with autosomal dominant cerebellar ataxia [corrected]. Am J Hum Genet. Jan. 2003;72(1):191-9. Epub Dec. 13, 2002.
Vanamee et al., FokI requires two specific DNA sites for cleavage. J Mol Biol. May 25, 2001;309(1):69-78.
Vitreschak et al., Regulation of the vitamin B12 metabolism and transport in bacteria by a conserved RNA structural element. RNA. Sep. 2003;9(9):1084-97.
Wacey et al., Disentangling the perturbational effects of amino acid substitutions in the DNA-binding domain of p53. Hum Genet. Jan. 1999;104(1):15-22.
Wadia et al., Modulation of cellular function by TAT mediated transduction of full length proteins. Curr Protein Pept Sci. Apr. 2003;4(2):97-104.
Wadia et al., Transducible TAT-HA fusogenic peptide enhances escape of TAT-fusion proteins after lipid raft macropinocytosis. Nat Med. Mar. 2004;10(3):310-5. Epub Feb. 8, 2004.
Wah et al., Structure of FokI has implications for DNA cleavage. Proc Natl Acad Sci U S A. Sep. 1, 1998;95(18):10564-9.
Wang et al., Efficient delivery of genome-editing proteins using bioreducible lipid nanoparticles. Proc Natl Acad Sci U S A. Feb. 29, 2016. pii: 201520244. [Epub ahead of print].
Wang et al., Genetic screens in human cells using the CRISPR-Cas9 system. Science. Jan. 3, 2014;343(6166):80-4. doi: 10.1126/science.1246981. Epub Dec. 12, 2013.
Wang et al., Nucleation, propagation and cleavage of target RNAs in Ago silencing complexes. Nature. Oct. 8, 2009;461(7265):754-61. doi: 10.1038/nature08434.

(56) References Cited

OTHER PUBLICATIONS

Wang et al., One-step generation of mice carrying mutations in multiple genes by CRISPR/Cas-mediated genome engineering. Cell. May 9, 2013;153(4):910-8. doi: 10.1016/j.cell.2013.04.025. Epub May 2, 2013.
Wang et al., Recombinase technology: applications and possibilities. Plant Cell Rep. Mar. 2011;30(3):267-85. doi: 10.1007/s00299-010-0938-1. Epub Oct. 24, 2010.
Wang et al., Riboswitches that sense S-adenosylhomocysteine and activate genes involved in coenzyme recycling. Mol Cell. Mar. 28, 2008;29(6):691-702. doi: 10.1016/j.molcel.2008.01.012.
Wang et al., Targeted gene addition to a predetermined site in the human genome using a ZFN-based nicking enzyme. Genome Res. Jul. 2012;22(7):1316-26. doi: 10.1101/gr.122879.111. Epub Mar. 20, 2012.
Wang et al., Uracil-DNA glycosylase inhibitor gene of bacteriophage PBS2 encodes a binding protein specific for uracil-DNA glycosylase. J Biol Chem. Jan. 15, 1989;264(2):1163-71.
Warren et al., A chimeric Cre recombinase with regulated directionality. Proc Natl Acad Sci U S A. Nov. 25, 2008;105(47):18278-83. doi: 10.1073/pnas.0809949105. Epub Nov. 14, 2008.
Warren et al., Mutations in the amino-terminal domain of lambda-integrase have differential effects on integrative and excisive recombination. Mol Microbiol. Feb. 2005;55(4):1104-12.
Weber et al., Assembly of designer TAL effectors by Golden Gate cloning. PLoS One. 2011;6(5):e19722. doi:10.1371/journal.pone.0019722. Epub May 19, 2011.
Weinberger et al., Disease-causing mutations C277R and C277Y modify gating of human ClC-1 chloride channels in myotonia congenita. J Physiol. Aug. 1, 2012;590(Pt 15):3449-64. doi: 0.1113/jphysiol.2012.232785. Epub May 28, 2012.
Wiedenheft et al., RNA-guided genetic silencing systems in bacteria and archaea. Nature. Feb. 15, 2012;482(7385):331-8. doi: 10.1038/nature10886. Review.
Wijnker et al., Managing meiotic recombination in plant breeding. Trends Plant Sci. Dec. 2008;13(12):640-6. doi: 10.1016/j.tplants.2008.09.004. Epub Oct. 22, 2008.
Wolf et al., tadA, an essential tRNA-specific adenosine deaminase from *Escherichia coli*. EMBO J. Jul. 15, 2002;21(14):3841-51.
Wolfe et al., Analysis of zinc fingers optimized via phage display: evaluating the utility of a recognition code. J Mol Biol. Feb. 5, 1999;285(5):1917-34.
Wood et al., Targeted genome editing across species using ZFNs and TALENs. Science. Jul. 15, 2011;333(6040):307. doi: 10.1126/science.1207773. Epub Jun. 23, 2011.
Wu et al., Correction of a genetic disease in mouse via use of CRISPR-Cas9. Cell Stem Cell. Dec. 5, 2013;13(6):659-62. doi: 10.1016/j.stem.2013.10.016.
Wu et al., Genome-wide binding of the CRISPR endonuclease Cas9 in mammalian cells. Nat Biotechnol. Jul. 2014;32(7):670-6. doi: 10.1038/nbt.2889. Epub Apr. 20, 2014.
Xu et al., Sequence determinants of improved CRISPR sgRNA design. Genome Res. Aug. 2015;25(8):1147-57. doi: 10.1101/gr.191452.115. Epub Jun. 10, 2015.
Yamano et al., Crystal Structure of Cpf1 in Complex with Guide RNA and Target DNA. Cell May 2016;165(4)949-62.
Yang et al., Engineering and optimising deaminase fusions for genome editing. Nat Commun. Nov. 2, 2016;7:13330. doi: 10.1038/ncomms13330.
Yang et al., Genome editing with targeted deaminases. BioRxiv. Preprint. First posted online Jul. 28, 2016.
Yang et al., PAM-dependent Target DNA Recognition and Cleavage by C2C1 CRISPR-Cas endonuclease. Cell Dec. 2016;167(7):1814-28.
Yanover et al., Extensive protein and DNA backbone sampling improves structure-based specificity prediction for C2H2 zinc fingers. Nucleic Acids Res. Jun. 2011;39(11):4564-76. doi: 10.1093/nar/gkr048. Epub Feb. 22, 2011.
Yazaki et al., Hereditary systemic amyloidosis associated with a new apolipoprotein AII stop codon mutation Stop78Arg. Kidney Int. Jul. 2003;64(1):11-6.
Yin et al., Genome editing with Cas9 in adult mice corrects a disease mutation and phenotype. Nat Biotechnol. Jun. 2014;32(6):551-3. doi: 10.1038/nbt.2884. Epub Mar. 30, 2014.
Yuan et al., Tetrameric structure of a serine integrase catalytic domain. Structure. Aug. 6, 2008;16(8):1275-86. doi: 10.1016/j.str.2008.04.018.
Yuen et al., Control of transcription factor activity and osteoblast differentiation in mammalian cells using an evolved small-molecule-dependent intein. J Am Chem Soc. Jul. 12, 2006;128(27):8939-46.
Zelphati et al., Intracellular delivery of proteins with a new lipid-mediated delivery system. J Biol Chem. Sep. 14, 2001;276(37):35103-10. Epub Jul. 10, 2001.
Zetsche et al., A split-Cas9 architecture for inducible genome editing and transcription modulation. Nat Biotechnol. Feb. 2015;33(2):139-42. doi: 10.1038/nbt.3149.
Zetsche et al., Cpf1 is a single RNA-guided endonuclease of a class 2 CRISPR-Cas system. Cell. Oct. 22, 2015;163(3):759-71. doi: 10.1016/j.cell.2015.09.038. Epub Sep. 25, 2015.
Zhang et al., Comparison of non-canonical PAMs for CRISPR/Cas9-mediated DNA cleavage in human cells. Sci Rep. Jun. 2014;4:5405.
Zhang et al., Conditional gene manipulation: Cre-ating a new biological era. J Zhejiang Univ Sci B. Jul. 2012;13(7):511-24. doi: 10.1631/jzus.B1200042. Review.
Zhang et al., CRISPR/Cas9 for genome editing: progress, implications and challenges. Hum Mol Genet. Sep. 15, 2014;23(R1):R40-6. doi: 10.1093/hmg/ddu125. Epub Mar. 20, 2014.
Zhang et al., Efficient construction of sequence-specific TAL effectors for modulating mammalian transcription. Nat Biotechnol. Feb. 2011;29(2):149-53. doi: 10.1038/nbt.1775. Epub Jan. 19, 2011.
Zhang et al., Programmable base editing of zebrafish genome using a modified CRISPR-Cas9 system. Nat Commun. Jul. 25, 2017;8(1):118. doi: 10.1038/s41467-017-00175-6.
Zheng et al., DNA editing in DNA/RNA hybrids by adenosine deaminases that act on RNA. Nucleic Acids Res. Apr. 7, 2017;45(6):3369-3377. doi: 10.1093/nar/gkx050.
Zong et al., Precise base editing in rice, wheat and maize with a Cas9-cytidine deaminase fusion. Nat Biotechnol. May 2017;35(5):438-440. doi: 10.1038/nbt.3811. Epub Feb. 27, 2017.
Zorko et al., Cell-penetrating peptides: mechanism and kinetics of cargo delivery. Adv Drug Deliv Rev. Feb. 28, 2005;57(4):529-45. Epub Jan. 22, 2005.
Zou et al., Gene targeting of a disease-related gene in human induced pluripotent stem and embryonic stem cells. Cell Stem Cell. Jul. 2, 2009;5(1):97-110. doi: 10.1016/j.stem.2009.05.023. Epub Jun. 18, 2009.
Zuris et al., Cationic lipid-mediated delivery of proteins enables efficient protein-based genome editing in vitro and in vivo. Nat Biotechnol. 2015;33:73-80.
U.S. Appl. No. 61/838,178, Joung et al., filed Jun. 21, 2013.
U.S. Appl. No. 61/874,682, Liu et al., filed Sep. 6, 2013.
U.S. Appl. No. 61/874,746, Liu et al., filed Sep. 6, 2013.
U.S. Appl. No. 62/357,332, Liu et al., filed Jun. 30, 2016.
Aihara et al., A conformational switch controls the DNA cleavage activity of lambda integrase. Mol Cell. Jul. 2003;12(1):187-98.
Ames et al., A eubacterial riboswitch class that senses the coenzyme tetrahydrofolate. Chem Biol. Jul. 30, 2010;17(7):681-5. doi: 10.1016/j.chembiol.2010.05.020.
Batey et al., Structure of a natural guanine-responsive riboswitch complexed with the metabolite hypoxanthine. Nature. Nov. 18, 2004;432(7015):411-5.
Bershtein et al., Advances in laboratory evolution of enzymes. Curr Opin; Chem Biol. Apr. 2008;12(2):151-8. doi: 10.1016/j.cbpa.2008.01.027. Epub Mar. 7, 2008. Review.
Billon et al., CRISPR-Mediated Base Editing Enables Efficient Disruption of Eukaryotic Genes through Induction of STOP Codons. Mol Cell. Sep. 21, 2017;67(6):1068-1079.e4. doi: 10.1016/j.molcel.2017.08.008. Epub Sep. 7, 2017.

(56) References Cited

OTHER PUBLICATIONS

Bogdanove et al., TAL effectors: customizable proteins for DNA targeting. Science. Sep. 30, 2011;333(6051):1843-6. doi: 10.1126/science.1204094.

Bohlke et al., Sense codon emancipation for proteome-wide incorporation of noncanonical amino acids: rare isoleucine codon AUA as a target for genetic code expansion. FEMS Microbiol Lett. Feb. 2014;351(2):133-44. doi: 10.1111/1574-6968.12371. Epub Jan. 27, 2014.

Bolotin et al., Clustered regularly interspaced short palindrome repeats (CRISPRs) have spacers of extrachromosomal origin. Microbiology. Aug. 2005;151(Pt 8):2551-61.

Briner et al., Guide RNA functional modules direct Cas9 activity and orthogonality. Mol Cell. Oct. 23, 2014;56(2):333-339. doi: 10.1016/j.molcel.2014.09.019.

Brouns et al., Small CRISPR RNAs guide antiviral defense in prokaryotes. Science. Aug. 15, 2008;321(5891):960-4. doi: 10.1126/science.1159689.

Buchwald et al., Long-term, continuous intravenous heparin administration by an implantable infusion pump in ambulatory patients with recurrent venous thrombosis. Surgery. Oct. 1980;88(4):507-16.

Budisa et al., Residue-specific bioincorporation of non-natural, biologically active amino acids into proteins as possible drug carriers: structure and stability of the per-thiaproline mutant of annexin V. Proc Natl Acad Sci U S A. Jan. 20, 1998;95(2):455-9.

Buskirk et al., Directed evolution of ligand dependence: small-molecule-activated protein splicing. Proc Natl Acad Sci U S A. Jul. 20, 2004;101(29):10505-10. Epub Jul. 9, 2004.

Böck et al., Selenocysteine: the 21st amino acid. Mol Microbiol. Mar. 1991;5(3):515-20.

Carroll, Genome engineering with zinc-finger nucleases. Genetics. Aug. 2011;188(4):773-82. doi: 10.1534/genetics.111.131433. Review.

Chavez et al., Precise Cas9 targeting enables genomic mutation prevention. bioRxiv. Jun. 14, 2016; http://dx/doi.oreg/10.1101/058974. 6 pages.

Chelico et al., Stochastic properties of processive cytidine DNA deaminases AID and APOBEC3G. Philos Trans R Soc Lond B Biol Sci. Mar. 12, 2009;364(1517):583-93. doi: 10.1098/rstb.2008.0195.

Chen et al., Fusion protein linkers: property, design and functionality. Adv Drug Deliv Rev. Oct. 2013;65(10):1357-69. doi:10.1016/j.addr.2012.09.039. Epub Sep. 29, 2012.

Cobb et al., Directed evolution as a powerful synthetic biology tool. Methods. Mar. 15, 2013;60(1):81-90. doi: 10.1016/j.ymeth.2012.03.009. Epub Mar. 23, 2012.

Covino et al., The CCL2/CCR2 Axis in the Pathogenesis of HIV-1 Infection: A New Cellular Target for Therapy? Current Drug Targets Dec. 2016;17(1):76-110. DOI : 10.2174/1389450117011512171110917.

Davis et al., DNA double strand break repair via non-homologous end-joining. Transl Cancer Res. Jun. 2013;2(3):130-143.

Ding et al., Permanent alteration of PCSK9 with in vivo CRISPR-Cas9 genome editing. Circ Res. Aug. 15, 2014;115(5):488-92. doi: 10.1161/CIRCRESAHA.115.304351. Epub Jun. 10, 2014.

Dixon et al., Reengineering orthogonally selective riboswitches. Proc Natl Acad Sci U S A. Feb. 16, 2010;107(7):2830-5. doi: 10.1073/pnas.0911209107. Epub Jan. 26, 2010.

Doench et al., Optimized sgRNA design to maximize activity and minimize off-target effects of CRISPR-Cas9. Nat Biotechnol. Feb. 2016;34(2):184-191. doi: 10.1038/nbt.3437.

Dumas et al., Designing logical codon reassignment—Expanding the chemistry in biology. Chem Sci. Jan. 1, 2015;6(1):50-69. doi: 10.1039/c4sc01534g. Epub Jul. 14, 2014. Review.

During et al., Controlled release of dopamine from a polymeric brain implant: in vivo characterization. Ann Neurol. Apr. 1989;25(4):351-6.

Edwards et al., An *Escherichia coli* tyrosine transfer RNA is a leucine-specific transfer RNA in the yeast *Saccharomyces cerevisiae*. Proc Natl Acad Sci U S A. Feb. 15, 1991;88(4):1153-6.

Edwards et al., Crystal structures of the thi-box riboswitch bound to thiamine pyrophosphate analogs reveal adaptive RNA-small molecule recognition. Structure. Sep. 2006;14(9):1459-68.

Endo et al., Toward establishing an efficient and versatile gene targeting system in higher plants. Biocatalysis and Agricultural Biotechnology 2014;3,(1):2-6.

Esvelt et al., A system for the continuous directed evolution of biomolecules. Nature. Apr. 28, 2011;472(7344):499-503. doi: 10.1038/nature09929. Epub Apr. 10, 2011.

Fagerlund et al., The Cpf1 CRISPR-Cas protein expands genome-editing tools. Genome Biology Nov. 17, 2015;16:251. haps://doi.org/10.1186/s13059-015-0824-9.

Fang et al., Synthetic Studies Towards Halichondrins: Synthesis of the Left Halves of Norhalichondrins and Homohalichondrins. Tetrahedron Letters 1992;33(12):1557-1560.

Farhood et al., Codelivery to mammalian cells of a transcriptional factor with cis-acting element using cationic liposomes. Anal Biochem. Feb. 10, 1995;225(1):89-93.

Ferretti et al., Complete genome sequence of an M1 strain of *Streptococcus pyogenes*. Proc Natl Acad Sci U S A. Apr. 10, 2001;98(8):4658-63.

Ferry et al., Rational design of inducible CRISPR guide RNAs for de novo assembly of transcriptional programs. Nat Commun. Mar. 3, 2017;8:14633. doi: 10.1038/ncomms14633.

Fischer et al., Cryptic epitopes induce high-titer humoral immune response in patients with cancer. J Immunol. Sep. 1, 2010;185(5):3095-102. doi: 10.4049/jimmunol.0902166. Epub Jul. 26, 2010.

Fukui et al., DNA Mismatch Repair in Eukaryotes and Bacteria. J Nucleic Acids. Jul. 27, 2010;2010. pii: 260512. doi: 10.4061/2010/260512.

Garneau et al., The CRISPR/Cas bacterial immune system cleaves bacteriophage and plasmid DNA. Nature. Nov. 4, 2010;468(7320):67-71. doi: 10.1038/nature09523.

Haeussler et al., Evaluation of off-target and on-target scoring algorithms and integration into the guide RNA selection tool CRISPOR. Genome Biol. Jul. 5, 2016;17(1):148. doi: 10.1186/s13059-016-1012-2.

Hamano-Takaku et al., A mutant *Escherichia coli* tyrosyl-tRNA synthetase utilizes the unnatural amino acid azatyrosine more efficiently than tyrosine. J Biol Chem. Dec. 22, 2000;275(51):40324-8.

Hayes et al., Stop codons preceded by rare arginine codons are efficient determinants of SsrA tagging in *Escherichia coli*. Proc Natl Acad Sci U S A. Mar. 19, 2002;99(6):3440-5. Epub Mar. 12, 2002.

Heller et al., Replisome assembly and the direct restart of stalled replication forks. Nat Rev Mol Cell Biol. Dec. 2006;7(12):932-43. Epub Nov. 8, 2006.

Hickford et al., Antitumour polyether macrolides: four new halichondrins from the New Zealand deep-water marine sponge *Lissodendoryx* sp. Bioorg Med Chem. Mar. 15, 2009;17(6):2199-203. doi: 10.1016/j.bmc.2008.10.093. Epub Nov. 19, 2008.

Hida et al., Directed evolution for drug and nucleic acid; delivery. Adv Drug Deliv Rev. Dec. 22, 2007;59(15):1562-78. Epub Aug. 28, 2007; Review.

Howard et al., Intracerebral drug delivery in rats with lesion-induced memory deficits. J Neurosurg. Jul. 1989;71(1):105-12.

Hu et al., Chemical Biology Approaches to Genome Editing: Understanding, Controlling, and Delivering Programmable Nucleases. Cell Chem Biol. Jan. 21, 2016;23(1):57-73. doi: 10.1016/j.chembiol.2015.12.009.

Husimi, Selection and evolution of bacteriophages in cellstat. Adv Biophys. ; 1989;25:1-43. Review.

Hwang et al., Efficient In Vivo Genome Editing Using RNA-Guided Nucleases. Nat Biotechnol. Mar. 2013; 31(3): 227-229. doi: 10.1038/nbt.2501. Epub Jan. 29, 2013.

Ishino et al., Nucleotide sequence of the iap gene, responsible for alkaline phosphatase isozyme conversion in *Escherichia coli*, and identification of the gene product. J Bacteriol. Dec. 1987;169(12):5429-33.

Jansen et al., Identification of genes that are associated with DNA repeats in prokaryotes. Mol Microbiol. Mar. 2002;43(6):1565-75.

Kakiyama et al., A peptide release system using a photo-cleavable linker in a cell array format for cell-toxicity analysis. Polymer J. Feb. 27, 2013;45:535-9.

Kang et al., Structural Insights into riboswitch control of the biosynthesis of queuosine, a modified nucleotide found in the

(56) References Cited

OTHER PUBLICATIONS anticodon of tRNA. Mol Cell. Mar. 27, 2009;33(6):784-90. doi: 10.1016/j.molcel.2009.02.019. Epub Mar. 12, 2009.

Kiga et al., An engineered *Escherichia coli* tyrosyl-tRNA synthetase for site-specific incorporation of an unnatural amino acid into proteins in eukaryotic translation and its application in a wheat germ cell-free system. Proc Natl Acad Sci U S A. Jul. 23, 2002;99(15):9715-20. Epub Jul. 3, 2002.

Klein et al., Cocrystal structure of a class I preQ1 riboswitch reveals a pseudoknot recognizing an essential hypermodified nucleobase. Nat Struct Mol Biol. Mar. 2009;16(3):343-4. doi: 10.1038/nsmb.1563.Epub Feb. 22, 2009.

Kohli et al., Local sequence targeting in the AID/APOBEC family differentially impacts retroviral restriction and antibody diversification. J Biol Chem. Dec. 24, 2010;285(52):40956-64. doi: 10.1074/jbc.M110.177402. Epub Oct. 6, 2010.

Komor et al., CRISPR-Based Technologies for the Manipulation of Eukaryotic Genomes. Cell. Jan. 12, 2017;168(1-2):20-36. doi: 10.1016/j.cell.2016.10.044.

Komor et al., Improved base excision repair inhibition and bacteriophage Mu Gam protein yields C:G-to-T:A base editors with higher efficiency and product purity. Sci Adv. Aug. 30, 2017;3(8):eaao4774. doi: 10.1126/sciadv.aao4774. eCollection Aug. 2017.

Kouzminova et al., Patterns of chromosomal fragmentation due to uracil-DNA incorporation reveal a novel mechanism of replication-dependent double-stranded breaks. Mol Microbiol. Apr. 2008;68(1):202-15. doi: 10.1111/j.1365-2958.2008.06149.x.

Kowal et al., Exploiting unassigned codons in Micrococcus luteus for tRNA-based amino acid mutagenesis. Nucleic Acids Res. Nov. 15, 1997;25(22):4685-9.

Kunz et al., DNA Repair in mammalian cells: Mismatched repair: variations on a theme. Cell Mol Life Sci. Mar. 2009;66(6):1021-38. doi: 10.1007/s00018-009-8739-9.

Kury et al., De Novo Disruption of the Proteasome Regulatory Subunit PSMD12 Causes a Syndromic Neurodevelopmental Disorder. Am J Hum Genet. Feb. 2, 2017;100(2):352-363. doi: 10.1016/j.ajhg.2017.01.003. Epub Jan. 26, 2017.

Kwon et al., Chemical basis of glycine riboswitch cooperativity. RNA. Jan. 2008;14(1):25-34. Epub Nov. 27, 2007.

Köhrer et al., A possible approach to site-specific insertion of two different unnatural amino acids into proteins in mammalian cells via nonsense suppression. Chem Biol. Nov. 2003;10(11):1095-102.

Köhrer et al., Complete set of orthogonal 21st aminoacyl-tRNA synthetase-amber, ochre and opal suppressor tRNA pairs: concomitant suppression of three different termination codons in an mRNA in mammalian cells. Nucleic Acids Res. Dec. 1, 2004;32(21):6200-11. Print 2004.

Langer et al., Chemical and Physical Structure of Polymers as Carriers for Controlled Release of Bioactive Agents: A Review. Journal of Macromolecular Science, 2006;23(1):61-126. DOI: 10.1080/07366578308079439.

Langer et al., New methods of drug delivery. Science. Sep. 28, 1990;249(4976):1527-33.

Lee et al., An allosteric self-splicing ribozyme triggered by a bacterial second messenger. Science. Aug. 13, 2010;329(5993):845-8. doi: 10.1126/science.1190713.

Lee et al., Failure to detect DNA-guided genome editing using Natronobacterium gregoryi Argonaute. Nat Biotechnol. Nov. 28, 2016;35(1):17-18. doi: 10.1038/nbt.3753.

Lee et al., Ribozyme Mediated gRNA Generation for In Vitro and In Vivo CRISPR/Cas9 Mutagenesis. PLoS One. Nov. 10, 2016;11(11):e0166020. doi: 10.1371/journal.pone.0166020. eCollection 2016.

Levy et al., Inhibition of calcification of bioprosthetic heart valves by local controlled-release diphosphonate. Science. Apr. 12, 1985;228(4696):190-2.

Lewis et al., Building the Class 2 CRISPR-Cas Arsenal. Mol Cell 2017;65(3);377-379.

Li et al., Base editing with a Cpf1-cytidine deaminase fusion. Nat Biotechnol. Apr. 2018;36(4):324-327. doi: 10.1038/nbt.4102. Epub Mar. 19, 2018.

Li et al., Multiplex and homologous recombination-mediated genome editing in *Arabidopsis* and Nicotiana benthamiana using guide RNA and Cas9. Nat Biotechnol. Aug. 2013;31(8):688-91. doi: 10.1038/nbt.2654.

Liang et al., Rapid and highly efficient mammalian cell engineering via Cas9 protein transfection. Send to; J Biotechnol. Aug. 20, 2015;208:44-53. doi: 10.1016/j.jbiotec.2015.04.024.

Lieber et al., Mechanism and regulation of human non-homologous DNA end-joining. Nat Rev Mol Cell Biol. Sep. 2003;4(9):712-20.

Link et al., Engineering ligand-responsive gene-control elements: lessons learned from natural riboswitches. Gene Ther. Oct. 2009;16(10):1189-201. doi: 10.1038/gt.2009.81. Epub Jul. 9, 2009. Review.

Liu et al., Balancing AID and DNA repair during somatic hypermutation. Trends Immunol. Apr. 2009;30(4):173-81. doi: 10.1016/j.it.2009.01.007.

Liu et al., Distance determination by GIY-YIG intron endonucleases: discrimination between repression and cleavage functions. Nucleic Acids Res. Mar. 31, 2006;34(6):1755-64. Print 2006.

Liu et al., Engineering a tRNA and aminoacyl-tRNA synthetase for the site-specific incorporation of unnatural amino acids into proteins in vivo. Proc Natl Acad Sci U S A. Sep. 16, 1997;94(19):10092-7.

Liu et al., Fast Colorimetric Sensing of Adenosine and Cocaine Based on a General Sensor Design Involving Aptamers and Nanoparticles. Angew Chem. Dec. 16, 2006;45(1):90-4. DOI: 10.1002/anie.200502589.

Makarova et al., An updated evolutionary classification of CRISPR-Cas systems. Nat Rev Microbiol. Nov. 2015;13(11):722-36. doi: 10.1038/nrmicro3569. Epub Sep. 28, 2015.

Makarova et al., Evolution and classification of the CRISPR-Cas systems. Nat Rev Microbiol. Jun. 2011;9(6):467-77. doi: 10.1038/nrmicro2577. Epub May 9, 2011.

Marraffini et al., CRISPR interference limits horizontal gene transfer in staphylococci by targeting DNA. Science. Dec. 19, 2008;322(5909):1843-5. doi: 10.1126/science.1165771.

Mei et al., Recent Progress in CRISPR/Cas9 Technology. J Genet Genomics. Feb. 20, 2016;43(2):63-75. doi: 10.1016/j.jgg.2016.01.001. Epub Jan. 18, 2016.

Meyer et al., Confirmation of a second natural preQ1 aptamer class in Streptococcaceae bacteria. RNA. Apr. 2008;14(4):685-95. doi: 10.1261/rna.937308. Epub Feb. 27, 2008.

Mojica et al., Intervening sequences of regularly spaced prokaryotic repeats derive from foreign genetic elements. J Mol Evol. Feb. 2005;60(2):174-82.

Monahan et al., Site-specific incorporation of unnatural amino acids into receptors expressed in Mammalian cells. Chem Biol. Jun. 2003;10(6):573-80.

Montange et al., Structure of the S-adenosylmethionine riboswitch regulatory mRNA element. Nature. Jun. 29, 2006;441(7097):1172-5.

Mootz et al., Conditional protein splicing: a new tool to control protein structure and function in vitro and in vivo. J Am Chem Soc. Sep. 3, 2006;125(35):10561-9.

Mootz et al., Protein splicing triggered by a small molecule. J Am Chem Soc. Aug. 7, 2002;124(31):9044-5.

Neel et al., Riboswitches: Classification, function and in silico approach, International Journal of Pharma Sciences and Research. 2010;1(9):409-420.

Nelson et al., Filamentous phage DNA cloning vectors: a noninfective mutant with a nonpolar deletion in gene III. Virology. 1981; 108(2): 338-50.

Ni et al., Nucleic acid aptamers: clinical applications and promising new horizons. Curr Med Chem. 2011;18(27):4206-14. Review.

Pearl, Structure and function in the uracil-DNA glycosylase superfamily. Mutat Res. Aug. 30, 2000;460(3-4):165-81.

Peck et al., Directed evolution of a small-molecule-triggered intein with improved splicing properties in mammalian cells. Chem Biol. May 27, 2011;18(5):619-30. doi: 10.1016/j.chembiol.2011.02.014.

(56) References Cited

OTHER PUBLICATIONS

Plosky et al., CRISPR-Mediated Base Editing without DNA Double-Strand Breaks. Mol Cell. May 19, 2016;62(4):477-8. doi: 10.1016/j.molcel.2016.05.006.
Pourcel et al., CRISPR elements in Yersinia pestis acquire new repeats by preferential uptake of bacteriophage DNA, and provide additional tools for evolutionary studies. Microbiology. Mar. 2005;151(Pt 3):653-63.
Rakonjac et al., Roles of PIII in filamentous phage assembly. J Mol Biol. 1998; 282(1)25-41.
Ray et al., Homologous recombination: ends as the means. Trends Plant Sci. Oct. 2002;7(10):435-40.
Richter et al., Function and regulation of clustered regularly interspaced short palindromic repeats (CRISPR) / CRISPR associated (Cas) systems. Viruses. Oct. 19, 2012;4(10):2291-311. doi: 10.3390/v4102291.
Riechmann et al.,. The C-terminal domain of TolA is the coreceptor for filamentous phage infection of $E.$ $coli$. Cell. 1997; 90(2):351-60. PMID:9244308.
Rudolph et al., Synthetic riboswitches for the conditional control of gene expression in Streptomyces coelicolor. Microbiology. Jul. 2013;159(Pt 7):1416-22. doi: 10.1099/mic.0.067322-0. Epub May 15, 2013.
Saleh-Gohari et al., Conservative homologous recombination preferentially repairs DNA double-strand breaks in the S phase of the cell cycle in human cells. Nucleic Acids Res. Jul. 13, 2004;32(12):3683-8. Print 2004.
Saudek et al., A preliminary trial of the programmable implantable medication system for insulin delivery. N Engl J Med. Aug. 31, 1989;321(9):574-9.
Sefton et al., Implantable pumps. Crit Rev Biomed Eng. 1987;14(3):201-40.
Serganov et al., Coenzyme recognition and gene regulation by a flavin mononucleotide riboswitch. Nature. Mar. 12, 2009;458(7235):233-7. doi: 10.1038/nature07642. Epub Jan. 25, 2009.
Serganov et al., Structural basis for discriminative regulation of gene expression by adenine-and guanine-sensing mRNAs. Chem Biol. Dec. 2004;11(12):1729-41.
Serganov et al., Structural basis for gene regulation by a thiamine pyrophosphate-sensing riboswitch. Nature. Jun. 29, 2006;441(7097):1167-71. Epub May 21, 2006.
Sharma et al., Efficient introduction of aryl bromide functionality into proteins in vivo. FEBS Lett. Feb. 4, 2000;467(1):37-40.
Shcherbakova et al., Near-infrared fluorescent proteins for multicolor in vivo imaging. Nat Methods. Aug. 2013;10(8):751-4. doi: 10.1038/nmeth.2521. Epub Jun. 16, 2013.
Shee et al., Engineered proteins detect spontaneous DNA breakage in human and bacterial cells. Elife. Oct. 29, 2013;2:e01222. doi: 10.7554/eLife.01222.
Skretas et al., Regulation of protein activity with small-molecule-controlled inteins. Protein Sci. Feb. 2005;14(2):523-32. Epub Jan. 4, 2005.
Smith, Filamentous fusion phage: novel expression vectors that display cloned antigens on the virion surface. Science. Jun. 14, 1985;228(4705):1315-7.
Stephens et al., The landscape of cancer genes and mutational processes in breast cancer. Nature Jun. 2012;486:400-404. doi:10.1038/nature11017.
Sudarsan et al., An mRNA structure in bacteria that controls gene expression by binding lysine. Genes Dev. Nov. 1, 2003;17(21):2688-97.
Suess et al., A theophylline responsive riboswitch based on helix slipping controls gene expression in vivo. Nucleic Acids Res. Mar. 5, 2004;32(4):1610-4.
Tang et al., Aptazyme-embedded guide RNAs enable ligand-responsive genome editing and transcriptional activation. Nat Commun. Jun. 28, 2017;8:15939. doi: 10.1038/ncomms15939.
Tourdot et al., A general strategy to enhance immunogenicity of low-affinity HLA-A2. 1-associated peptides: implication in the identification of cryptic tumor epitopes. Eur J Immunol. Dec. 2000;30(12):3411-21.
Trausch et al., The structure of a tetrahydrofolate-sensing riboswitch reveals two ligand binding sites in a single aptamer. Structure. Oct. 12, 2011;19(10):1413-23. doi: 10.1016/j.str.2011.06.019. Epub Sep. 8, 2011.
Vagner et al., Efficiency of homologous DNA recombination varies along the Bacillus subtilis chromosome. J Bacteriol. Sep. 1988;170(9):3978-82.
Wals et al., Unnatural amino acid incorporation in $E.$ $coli$: current and future applications in the design of therapeutic proteins. Front Chem. Apr. 1, 2014;2:15. doi: 10.3389/fchem.2014.00015. eCollection 2014.
Wang et al., CRISPR-Cas9 Targeting of PCSK9 in Human Hepatocytes In Vivo-Brief Report. Arterioscler Thromb Vasc Biol. May 2016;36(5):783-6. doi: 10.1161/ATVBAHA.116.307227. Epub Mar. 3, 2016.
Weinberg et al., The aptamer core of SAM-IV riboswitches mimics the ligand-binding site of SAM-I riboswitches. RNA. May 2008;14(5):822-8. doi: 10.1261/rna.988608. Epub Mar. 27, 2008.
Winkler et al., An mRNA structure that controls gene expression by binding FMN. Proc Natl Acad Sci U S A. Dec. 10, 2002;99(25):15908-13. Epub Nov. 27, 2002.
Winkler et al., Control of gene expression by a natural metabolite-responsive ribozyme. Nature. Mar. 18, 2004;428(6980):281-6.
Winkler et al., Thiamine derivatives bind messenger RNAs directly to regulate bacterial gene expression. Nature. Oct. 31, 2002;419(6910):952-6. Epub Oct. 16, 2002.
Yahata et al., Unified, Efficient, and Scalable Synthesis of Halichondrins: Zirconium/Nickel-Mediated One-Pot Ketone Synthesis as the Final Coupling Reaction. Angew Chem Int Ed Engl. Aug. 28, 2017;56(36):10796-10800. doi: 10.1002/anie.201705523. Epub Jul. 28, 2017.
Yamamoto et al., Virological and immunological bases for HIV-1 vaccine design. Uirusu 2007;57(2):133-139. https://doi.org/10.2222/jsv.57.133.
Yang et al., New CRISPR-Cas systems discovered. Cell Res. Mar. 2017;27(3):313-314. doi: 10.1038/cr.2017.21. Epub Feb. 21, 2017.
Young et al., Beyond the canonical 20 amino acids: expanding the genetic lexicon. J Biol Chem. Apr. 9, 2010;285(15):11039-44. doi: 10.1074/jbc.R109.091306. Epub Feb. 10, 2010.
Yuan et al., Laboratory-directed protein evolution. Microbiol Mol Biol Rev. 2005; 69(3):37392. PMID: 16148303.
Zhang et al., Stabilized plasmid-lipid particles for regional gene therapy: formulation and transfection properties. Gene Ther. Aug. 1999;6(8):1438-47.
Zimmermann et al., Molecular interactions and metal binding in the theophylline-binding core of an RNA aptamer. RNA. May 2000;6(5):659-67.
Extended European Search Report for EP18199195.1, dated Feb. 12, 2019.
Extended European Search Report for EP 19181479.7, dated Oct. 31, 2019.
Extended European Search Report for EP 15830407.1, dated Mar. 2, 2018.
International Preliminary Report on Patentability for PCT/US2016/058344, dated May 3, 2018.
International Search Report for PCT/US2018/025887, dated Jun. 21, 2018.
International Preliminary Report on Patentability for PCT/US2014/048390, dated Mar. 7, 2019.
International Search Report and Written Opinion for PCT/US2017/068114, dated Mar. 20, 2018.
International Preliminary Report on Patentability for PCT/US2017/068114, dated Jul. 4, 2019.
International Search Report and Written Opinion for PCT/US2017/068105, dated Apr. 4, 2018.
International Preliminary Report on Patentability for PCT/US2017/068105, dated Jul. 4, 2019.
International Search Report for PCT/US2018/021880, dated Jun. 20, 2018.

(56) References Cited

OTHER PUBLICATIONS

International Preliminary Report on Patentability for PCT/US2018/021880, dated Sep. 19, 2019.
International Preliminary Report on Patentability for PCT/US2017/046144, dated Feb. 21, 2019.
International Preliminary Report on Patentability for PCT/US2017/045381, dated Feb. 14, 2019.
International Search Report for PCT/US2018/021664, dated Jun. 21, 2018.
International Preliminary Report on Patentability for PCT/US2018/021664, dated Sep. 19, 2019.
International Preliminary Report on Patentability for PCT/US2017/056671, dated Apr. 25, 2019.
Invitation to Pay Additional Fees for PCT/US2018/021878, dated Jun. 8, 2018.
International Search Report for PCT/US2018/021878, dated Aug. 20, 2018.
International Preliminary Report on Patentability for PCT/US2018/021878, dated Sep. 19, 2019.
International Search Report for PCT/US2018/024208, dated Aug. 23, 2018.
International Preliminary Report on Patentability for PCT/US2018/024208, dated Oct. 3, 2019.
International Search Report for PCT/US2018/032460, dated Jul. 11, 2018.
U.S. Appl. No. 16/266,937, filed Feb. 4, 2019, Liu et al.
U.S. Appl. No. 14/326,140, filed Mar. 4, 2016, Liu et al.
U.S. Appl. No. 15/852,891, filed Dec. 22, 2017, Maianti et al.
PCT/US2016/058344, May 3, 2018, International Preliminary Report on Patentability.
PCT/US2018/025887, Jun. 21, 2018, International Search Report.
PCT/US2014/048390, Mar. 7, 2019, International Preliminary Report on Patentability.
PCT/US2017/068114, Mar. 20, 2018, International Search Report and Written Opinion.
PCT/US2017/068114, Jul. 4, 2019, International Preliminary Report on Patentability.
PCT/US2017/068105, Apr. 4, 2018, International Search Report and Written Opinion.
PCT/US2017/068105, Jul. 4, 2019, International Preliminary Report on Patentability.
PCT/US2018/021880, Jun. 20, 2018, International Search Report.
PCT/US2018/021880, Sep. 19, 2019, International Preliminary Report on Patentability.
PCT/US2017/046144, Feb. 21, 2019, International Preliminary Report on Patentability.
PCT/US2017/045381, Feb. 14, 2019, International Preliminary Report on Patentability.
PCT/US2018/021664, Jun. 21, 2018, International Search Report.
PCT/US2018/021664, Sep. 19, 2019, International Preliminary Report on Patentability.
PCT/US2017/056671, Apr. 25, 2019, International Preliminary Report on Patentability.
PCT/US2018/021878, Jun. 8, 2018, Invitation to Pay Additional Fees.
PCT/US2018/021878, Aug. 20, 2018, International Search Report.
PCT/US2018/021878, Sep. 19, 2019, International Preliminary Report on Patentability.
PCT/US2018/024208, Aug. 23, 2018, International Search Report.
PCT/US2018/024208, Oct. 3, 2019, International Preliminary Report on Patentability.
PCT/US2018/032460, Jul. 11, 2018, International Search Report.
EP 18199195.1, Feb. 12, 2019, Extended European Search Report.
EP 19181479.7, Oct. 31, 2019, Extended European Search Report.
EP 15830407.1, Mar. 2, 2018, Extended European Search Report.
EP 123845790.0, Mar. 18, 2015, Partial Supplementary European Search Report.
EP 123845790.0, Oct. 12, 2015, Supplementary European Search Report.
PCT/US2012/047778, May 30, 2013, International Search Report and Written Opinion.
PCT/US2012/047778, Feb. 6, 2014, International Preliminary Report on Patentability.
PCT/US2014/052231, Dec. 4, 2014, International Search Report and Written Opinion.
PCT/US2014/052231, Jan. 30, 2015, International Search Report and Written Opinion (Corrected Version).
PCT/US2014/052231, Mar. 3, 2016, International Preliminary Report on Patentability.
PCT/US2014/050283, Nov. 6, 2014, International Search Report and Written Opinion.
PCT/US2014/050283, Feb. 18, 2016, International Preliminary Report on Patentability.
PCT/US2014/054247, Mar. 27, 2015, International Search Report and Written Opinion.
PCT/US2014/054247, Mar. 17, 2016, International Preliminary Report on Patentability.
PCT/US2014/054291, Dec. 18, 2014, Invitation to Pay Additional Fees.
PCT/US2014/054291, Mar. 27, 2015, International Search Report and Written Opinion.
PCT/US2014/054291, Mar. 17, 2016, International Preliminary Report on Patentability.
PCT/US2014/054252, Mar. 5, 2015, International Search Report and Written Opinion.
PCT/US2014/054252, Mar. 17, 2016, International Preliminary Report on Patentability.
PCT/US2014/070038, Apr. 14, 2015, International Search Report and Written Opinion.
PCT/US2014/070038, Jun. 23, 2016, International Preliminary Report on Patentability.
PCT/US2015/042770, Feb. 23, 2016, International Search Report and Written Opinion.
PCT/US2015/042770, Dec. 19, 2016, International Preliminary Report on Patentability.
PCT/US2015/058479, Feb. 11, 2016, International Search Report and Written Opinion.
PCT/US2015/058479, May 11, 2017, International Preliminary Report on Patentability.
PCT/US2016/044546, Dec. 28, 2016, International Search Report and Written Opinion.
PCT/US2016/058344, Mar. 1, 2017, Invitation to Pay Additional Fees.
PCT/US2016/058344, Apr. 20, 2017, International Search Report and Written Opinion.
PCT/US2017/48390, Nov. 7, 2017, Invitation to Pay Additional Fees.
PCT/US2017/48390, Jan. 9, 2018, International Search Report and Written Opinion.
PCT/US2017/046144, Oct. 10, 2017, International Search Report and Written Opinion.
PCT/US2017/045381, Oct. 26, 2017, International Search Report and Written Opinion.
PCT/US2017/056671, Dec. 21, 2017, Invitation to Pay Additional Fees.
PCT/US2017/056671, Feb. 20, 2018, International Search Report and Written Opinion.
U.S. Appl. No. 62/288,661, Muir et al., filed Jan. 29, 2016.
[No Author Listed] Score result for SEQ 355 to W020117032580. Muir et al. 2016.
D'Adda di Fagagna et al., The Gam protein of bacteriophage Mu is an orthologue of eukaryotic Ku. EMBO Rep. Jan. 2003;4(1):47-52.
Hirano et al., Structural Baths for the Altered PAM Specificities of Engineered CRISPR-Cas9. Mal Cell. Mar. 17, 2016;61(6):886-94. doi: 10.1016/j.molcel.2016.02.018.
Oakes et al., Protein engineering of Cas9 for enhanced function. Methods Enzymol. 2014;546:491-511.
Pelletier, CRISPR-Cas systems for the study of the immune function. Nov. 15, 2016. https://doi.org/10.1002/9780470015902.a0026896.

(56) References Cited

OTHER PUBLICATIONS

Yang et al., APOBEC: From mutator to editor. J Genet Genomics. Sep. 20, 2017;44(9):423-437, doi: 10.1016/j.jgg.2017.04.009. Epub Aug. 7, 2017.
International Preliminary Report on Patentability for PCT/US2018/032460, dated Nov. 21, 2019.
International Preliminary Report on Patentability for PCT/US2018/044242, dated Feb. 6, 2020.
International Search Report and Written Opinion for PCT/US2018/044242, dated Nov. 21, 2019.
International Search Report for PCT/US2018/048969, dated Jul. 31, 2019.
Partial European Search Report for Application No. EP 19187331.4, dated Dec. 19, 2019.
U.S. Appl. No. 14/234,031, filed Mar. 24, 2014, Liu et al.
U.S. Appl. No. 14/320,271, filed Jun. 30, 2014, Liu et al.
U.S. Appl. No. 16/441,751, filed Jun. 14, 2019, Liu et al.
U.S. Appl. No. 14/320,519, filed Jun. 30, 2014, Liu et al.
U.S. Appl. No. 14/913,458, filed Feb. 22, 2016, Liu et al.
U.S. Appl. No. 16/266,937, filed Feb. 5, 2019, Liu et al.
U.S. Appl. No. 14/320,370, filed Jun. 30, 2014, Liu et al.
U.S. Appl. No. 14/320,413, filed Jun. 30, 2014, Liu et al.
U.S. Appl. No. 14/874,123, filed Oct. 2, 2015, Liu et al.
U.S. Appl. No. 14/911,117, filed Feb. 9, 2016, Liu et al.
U.S. Appl. No. 14/462,163, filed Aug. 18, 2014, Liu et al.
U.S. Appl. No. 14/462,189, filed Aug. 18, 2014, Liu et al.
U.S. Appl. No. 14/916,679, filed Mar. 4, 2016, Liu et al.
U.S. Appl. No. 14/320,498, filed Jun. 30, 2014, Liu et al.
U.S. Appl. No. 14/320,467, filed Jun. 30, 2014, Liu et al.
U.S. Appl. No. 14/916,681, filed Mar. 4, 2016, Liu et al.
U.S. Appl. No. 14/326,329, filed Jul. 8, 2014, Liu et al.
U.S. Appl. No. 14/326,340, filed Jul. 8, 2014, Liu et al.
U.S. Appl. No. 14/326,361, filed Jul. 8, 2014, Liu et al.
U.S. Appl. No. 14/916,683, filed Mar. 4, 2016, Liu et al.
U.S. Appl. No. 14/325,815, filed Jul. 8, 2014, Liu et al.
U.S. Appl. No. 14/326,109, filed Jul. 8, 2014, Liu et al.
U.S. Appl. No. 14/326,140, filed Jul. 8, 2014, Liu et al.
U.S. Appl. No. 14/326,269, filed Jul. 8, 2014, Liu et al.
U.S. Appl. No. 14/326,290, filed Jul. 8, 2014, Liu et al.
U.S. Appl. No. 14/326,318, filed Jul. 8, 2014, Liu et al.
U.S. Appl. No. 14/326,303, filed Jul. 8, 2014, Liu et al.
U.S. Appl. No. 15/103,608, filed Jun. 10, 2016, Liu et al.
U.S. Appl. No. 16/374,634, filed Apr. 30, 2019, Liu et al.
U.S. Appl. No. 15/329,925, filed Jan. 27, 2017, Liu et al.
U.S. Appl. No. 16/132,276, filed Sep. 14, 2018, Liu et al.
U.S. Appl. No. 14/529,010, filed Oct. 30, 2014, Liu et al.
U.S. Appl. No. 15/958,721, filed Apr. 20, 2018, Liu et al.
U.S. Appl. No. 15/331,852, filed Oct. 22, 2016, Liu et al.
U.S. Appl. No. 15/960,171, filed Apr. 23, 2018, Liu et al.
U.S. Appl. No. 15/770,076, filed Apr. 20, 2018, Liu et al.
U.S. Appl. No. 16/327,744, filed Feb. 22, 2019, Maianti et al.
U.S. Appl. No. 15/852,526, filed Dec. 22, 2017, Maianti et al.
U.S. Appl. No. 16/492,534, filed Sep. 9, 2019, Liu et al.
U.S. Appl. No. 16/324,476, filed Feb. 8, 2019, Liu et al.
U.S. Appl. No. 15/791,085, filed Oct. 23, 2017, Liu et al.
U.S. Appl. No. 16/143,370, filed Sep. 26, 2018, Liu et al.
U.S. Appl. No. 16/492,548, filed Sep. 9, 2019, Liu et al.
U.S. Appl. No. 15/784,033, filed Oct. 13, 2017, Liu et al.
U.S. Appl. No. 16/492,553, filed Sep. 9, 2019, Liu et al.
U.S. Appl. No. 15/934,945, filed Mar. 23, 2018, Liu et al.
U.S. Appl. No. 16/643,376, filed Feb. 28, 2020, Liu et al.
U.S. Appl. No. 16/612,988, filed Nov. 12, 2019, Liu et al.
U.S. Appl. No. 16/634,405, filed Jan. 27, 2020, Liu et al.
EP 19187331.4, Dec. 19, 2019, Partial European Search Report.
PCT/US2018/048969, Jul. 31, 2019, International Search Report and Written Opinion.
PCT/US2018/032460, Nov. 21, 2019, International Preliminary Report on Patentability.
PCT/US2018/044242, Nov. 21, 2019, International Search Report and Written Opinion.
PCT/US2018/044242, Feb. 6, 2020, International Preliminary Report on Patentability.

\* cited by examiner

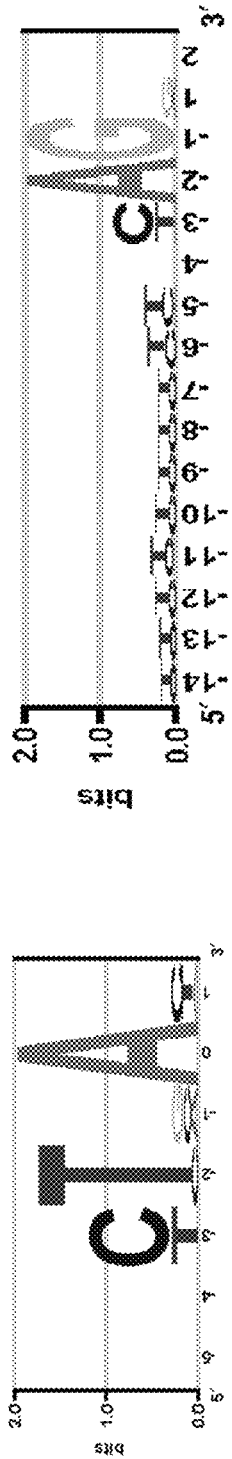

Figure 2B

CCR5 intron 2-exon 3 junction sequence

...ctgcagcaaacctteccttcactacaaacttcattgcttggccaaaagagagttaattcaatgtaga
catctatgtaggcaattaaaacagtatgatgtataaacagttgcatcatggaggcaactaaatacat
tctaggactttataaagatcactttattatttatgcacaGGTGGAACAAGATATGGATTATCAAGTCAAGT
CAATCTATGACATCAATTATTATACATCGGAGCCCTGCCAAAAAATCAAGTGAAGCAAATCGCAGC...

Figure 2C

```
atggattatcaagtgtcaagtccaatctatgacatcaattattatacatcggagccctgc  20
 M  D  Y  Q  V  S  S  P  I  Y  D  I  N  Y  Y  T  S  E  P  C
caaaaaatcaatgtgaagcaaatcgcagcccgcctcctgcctccgtctactcactggtg  40
 Q  K  I  N  V  K  Q  I  A  A  R  L  L  P  P  L  Y  S  L  V
ttcatctttggttttgtgggcaacatgctggtcatcctcatcctgataaactgcaaaagg  60
 F  I  F  G  F  V  G  N  M  L  V  I  L  I  L  I  N  C  K  R
ctgaagagcatgactgacatctacctgctcaacctggccatctctgacctgttttttcctt  80
 L  K  S  M  T  D  I  Y  L  L  N  L  A  I  S  D  L  F  F  L
cttactgtccccttctgggctcactatgctgcggcccagtgggactttggaaatacaatg 100
 L  T  V  F  W  A  H  Y  A  A  A  Q  D  F  G  N  T  M
tgtcaactcttgacaggctctatttatagcgttctctctggaatcttcttcatcatc 120
 C  Q  L  T  G  L  Y  F  I  G  F  F  S  G  I  F  F  I  I
ctcctgacaatcgataggtacctggctgtcgtccatgctgtgtttgctttaaaagccagg 140
 L  L  T  I  D  R  Y  L  A  V  V  H  A  V  F  A  L  K  A  R
acgtcacctttggggtggtgacaagtgtgatcacttgggtggtggctgtgtttgcgtct 160
 T  V  T  F  G  V  V  T  S  V  I  T  W  V  V  A  V  F  A  S
ctcccaggaatcatctttaccagatctcaaaaagaaggtcttcattacacctgcagctct 180
 L  P  G  I  I  F  T  R  S  Q  K  E  G  L  H  Y  T  C  S  S
catttccatacagtcagtatcaattctggaagaatttccagacattaaagatagtcatc 200
 H  F  P  Y  S  Q  Y  Q  F  W  K  N  F  Q  T  L  K  I  V  I
ttggggctggtcctgccgctgcttgtcatggtcatctgctactcgggaatcctaaaaact 220
 L  G  V  L  P  L  L  V  M  V  I  C  Y  S  G  I  L  K  T
ctgcttcggtgtcgaaatgagaagaagaggcacagggctgtgaggctatcttcaccatc 240
 L  L  R  C  R  N  E  K  K  R  H  R  A  V  R  L  I  F  T  I
atgattgtttatttctcttctggctccctacaacattgtccttctcctgaacaccttc 260
 M  I  V  Y  F  L  F  W  A  P  Y  N  I  V  L  L  N  T  F
caggaattctttggcctgaataattgcagtagctctaacaggttggaccaagctatgcag 280
 Q  E  F  F  G  L  N  N  C  S  S  N  R  L  D  Q  A  M  Q
gtgacagagactcttgggatgacgcactgctgcatcaacccatcatctatgcctttgtc 300
 V  T  E  T  L  G  M  T  H  C  C  I  N  P  I  I  Y  A  F  V
ggggagaagttcagaaactacctcttagtcttcttccaaaagcacattgccaaacgcttc 320
 G  E  K  F  R  N  Y  L  L  V  F  F  Q  K  S  I  A  K  R  F
tgcaaatgctgtctatttccagcaagaggctcccgagcgagcaagctcagtttacacc 340
 C  K  C  C  S  F  D  Q  E  A  E  R  A  S  S  V  Y  T
cgatccactggggagcaggaaatatctgtgggcttgtga
 R  S  T  G  E  Q  E  I  S  V  G  L  -
```

Figure 3

EDITING OF CCR5 RECEPTOR GENE TO PROTECT AGAINST HIV INFECTION

RELATED APPLICATIONS

This application claims priority under 35 U.S.C. § 119(e) to U.S. provisional patent application, U.S. Ser. No. 62/438,827, filed Dec. 23, 2016, which is incorporated herein by reference.

GOVERNMENT SUPPORT

This invention was made with government support under grant number GM065865, awarded by the National Institutes of Health (NIH). The government has certain rights in the invention.

BACKGROUND

C—C chemokine receptor type 5 (also commonly known as CCR5 or CD195) is a protein found on the surface of white blood cells. CCR5 acts as a receptor for chemokines and has demonstrated involvement in several different disease states including, but not limited to, human immunodeficiency virus (HIV) and acquired immune deficiency syndrome (AIDS). Many strains of HIV, the virus that causes AIDS, initially use CCR5 to enter and infect host cells. A mutation known as CCR5-Δ32 in the CCR5 gene has been shown to protect those individuals that carry it against these strains of HIV. Loss-of-function CCR5 mutants have generated significant interest in the biotech and pharmaceutical industries in light of the widespread and devastating effects of HIV/AIDS ("HIV/AIDS Fact sheet Updated July 2016" from the World Health Organization). However, existing methods and technologies for creating CCR5 loss-of-function mutants in vivo have been ineffective due to the large number of cells that need to be modified. Other concerns involve off-target effects, genome instability, or oncogenic modifications that may be caused by genome-editing treatments.

SUMMARY

Provided herein are systems, compositions, kits, and methods for modifying a polynucleotide (e.g. DNA) encoding a CCR5 protein to produce a loss-of-function CCR5 variant. Also provided are systems, compositions, kits, and methods for modifying a polynucleotide encoding a CCR2 protein to produce loss-of-function CCR2 mutants. The methodology relies on CRISPR/Cas9-based base-editing technology. The precise targeting methods described herein are superior to previously proposed strategies that create random indels in the CCR5 or CCR2 genomic locus using engineered nucleases. The methods also have a more favorable safety profile, due to low probability of off-target effects. Thus, the base editing methods described herein have a low impact on genomic stability, including oncogene activation or tumor suppressor inactivation. The loss-of-function CCR5 and/or CCR2 variants generated have a protective function against HIV infection (including prevention of HIV infection), decrease one or more symptoms of HIV infection, halt or delay progression of HIV to AIDS, and/or decrease one or more symptoms of AIDS.

Some aspects of the present disclosure provide a method of editing a polynucleotide encoding a C—C chemokine receptor type five (CCR5) protein, the method comprising contacting the CCR5-encoding polynucleotide with: (i) a fusion protein comprising: (a) a guide nucleotide sequence-programmable DNA binding protein domain; and (b) a cytosine deaminase domain; and (ii) a guide nucleotide sequence targeting the fusion protein of (i) to a target cytosine (C) base in the CCR5-encoding polynucleotide; wherein the contacting results in deamination of the target C base is by the fusion protein, resulting in a cytosine-guanine pair (C:G) to thymine-adenine pair (T:A) change in the CCR5-encoding polynucleotide. This may occur in any manner, and is not bound by any particular theory.

In one embodiment, the guide nucleotide sequence-programmable DNA binding protein domain is selected from the group consisting of: a nuclease inactive Cas9 (dCas9) domain, a nuclease inactive Cpf1 domain, a nuclease inactive Argonaute domain, and variants and combinations thereof. As a set of non limiting examples, any of the fusion proteins described herein that include a Cas9 domain, can use another guide nucleotide sequence-programmable DNA binding protein, such as CasX, CasY, Cpf1, C2c1, C2c2, C2c3, and Argonaute, in place of the Cas9 domain. Guide nucleotide sequence-programmable DNA binding protein include, without limitation, Cas9 (e.g., dCas9 and nCas9), CasX, CasY, Cpf1, C2c1, C2c2, C2C3, Argonaute, and any of suitable protein described herein.

In another embodiment, the guide nucleotide sequence-programmable DNA-binding protein domain comprises a nuclease inactive Cas9 (dCas9) domain. In some embodiments, the amino acid sequence of the dCas9 domain comprises mutations corresponding to D10A and/or H840A mutation(s) in SEQ ID NO: 1. In another embodiment, the amino acid sequence of the dCas9 domain comprises a mutation corresponding to a D10A mutation in SEQ ID NO: 1, and wherein the dCas9 domain comprises a histidine at the position corresponding to amino acid 840 of SEQ ID NO: 1.

In certain embodiments, the guide nucleotide sequence-programmable DNA-binding protein domain comprises a nuclease inactive Cpf1 (dCpf1) domain. In some embodiments, the dCpf1 domain is from a species of *Acidaminococcus* or Lachnospiraceae. In an embodiment, the guide nucleotide sequence-programmable DNA-binding protein domain comprises a nuclease inactive Argonaute (dAgo) domain. In a further embodiment, the dAgo domain is from *Natronobacterium gregoryi*.

As a set of non limiting examples, any of the fusion proteins described herein that include a Cas9 domain can use another guide nucleotide sequence-programmable DNA binding protein, such as CasX, CasY, Cpf1, C2c1, C2c2, C2c3, and Argonaute, in place of the Cas9 domain. These may be nuclease inactive variants of the proteins. Guide nucleotide sequence-programmable DNA binding protein include, without limitation, Cas9 (e.g., dCas9 and nCas9), saCas9 (e.g., saCas9d, saCas9n, saKKH Cas9), CasX, CasY, Cpf1, C2c1, C2c2, C2C3, Argonaute, and any of suitable protein described herein. In some embodiments, the fusion protein described herein comprises a Gam protein, a guide nucleotide sequence-programmable DNA binding protein, and a cytidine deaminase domain.

In some embodiments, the cytosine deaminase domain comprises an apolipoprotein B mRNA-editing complex (APOBEC) family deaminase. In an embodiment, the cytosine deaminase is selected from the group consisting of APOBEC1, APOBEC2, APOBEC3A, APOBEC3B, APOBEC3C, APOBEC3D, APOBEC3F, APOBEC3G deaminase, APOBEC3H deaminase, APOBEC4 deaminase, activation-induced deaminase (AID), and pmCDA1. In an embodiment, the cytosine deaminase comprises an amino acid sequence of any one of SEQ ID NOs: 270-292.

In some embodiments, the fusion protein of (a) further comprises a uracil glycosylase inhibitor (UGI) domain. In certain embodiments, the cytosine deaminase domain is fused to the N-terminus of the guide nucleotide sequence-programmable DNA-binding protein domain. In an embodiment, the UGI domain is fused to the C-terminus of the guide nucleotide sequence-programmable DNA-binding protein domain.

In some embodiments, the cytosine deaminase and the guide nucleotide sequence-programmable DNA-binding protein domain are fused via an optional linker. In another embodiment, the UGI domain is fused to the dCas9 domain via an optional linker.

In certain embodiments, the fusion protein comprises the structure NH$_2$-[cytosine deaminase domain]-[optional linker sequence]-[guide nucleotide sequence-programmable DNA-binding protein domain]-[optional linker sequence]-[UGI domain]-COOH.

In some embodiments, the linker comprises (GGGS)$_n$ (SEQ ID NO: 303), (GGGGS)$_n$ (SEQ ID NO: 304), (G)$_n$, (EAAAK), (SEQ ID NO: 305), (GGS)$_n$, SGSETPGTSESATPES (SEQ ID NO: 306), or (XP)$_n$ motif, or a combination of any of these, wherein n is independently an integer between 1 and 30, and wherein X is any amino acid. In an embodiment, the linker comprises the amino acid sequence SGSETPGTSESATPES (SEQ ID NO: 306). In another embodiment, the linker is (GGS)$_n$, and wherein n is 1, 3, or 7.

In certain embodiments, the fusion protein comprises the amino acid sequence of any one of SEQ ID NO: 293-302.

In an embodiment, the polynucleotide encoding the CCR5 protein comprises a coding strand and a complementary strand. In some embodiments, the polynucleotide encoding the CCR5 protein comprises a coding region and a non-coding region. In an embodiment, the C to T change occurs in the coding sequence of the CCR5-encoding polynucleotide. In some embodiments, the C to T change leads to a mutation in the CCR5 protein.

In some embodiments, the mutation in the CCR5 protein is a loss-of-function mutation. In certain embodiments, the mutation is selected from the mutations listed in Tables 1-10. In one embodiment, the guide nucleotide sequence is selected from the guide nucleotide sequences listed in Tables 3-5 and 8-10. In certain embodiments, the loss-of-function mutation introduces a premature stop codon in the CCR5 coding sequence that leads to a truncated or non-functional CCR5 protein. In certain embodiments, the premature stop codon is TAG (Amber), TGA (Opal), or TAA (Ochre).

In some embodiments, the premature stop codon is generated from a CAG to TAG change via the deamination of the first C on the coding strand. In certain embodiments, the premature stop codon is generated from a CGA to TGA change via the deamination of the first C on the coding strand. In an embodiment, the premature stop codon is generated from a CAA to TAA change via the deamination of the first C on the coding strand. In certain embodiments, the premature stop codon is generated from a TGG to TAG change via the deamination of the second C on the complementary strand. In an embodiment, the premature stop codon is generated from a TGG to TGA change via the deamination of the third C on the complementary strand. In an embodiment, the premature stop codon is generated from a TGG to TAA change via the deamination of the second C and third C on the complementary strand. In another embodiment, the premature stop codon is generated from a CGG to TAG or CGA to TAA change via the deamination of C on the coding strand and the deamination of C on the complementary strand.

In some embodiments, the guide nucleotide sequence is selected from the guide nucleotide sequences (SEQ ID NO: 381-657) listed in Table 3, Table 4, Table 5, Table 8, or Table 9. In certain embodiments, tandem premature stop codons are introduced. In one embodiment, the mutation is selected from the group consisting of: Q186X/Q188X, Q277X/Q288X, Q328X/Q329X, Q329X/R334X, or R341X/Q346X. In certain embodiments, the guide nucleotide sequence is selected from the group consisting of: SEQ ID NOs: 381-657. In some embodiments, two guide nucleotides are selected from SEQ ID NOs: 381-657. In some embodiments, three or more guide nucleotides are selected from SEQ ID NOs: 381-657.

In some embodiments, the loss-of-function mutation destabilizes CCR5 protein folding. In certain embodiments, the loss-of-function mutation is selected from the mutations listed in Tables 1-9. In specific embodiments, the guide nucleotide sequence is selected from the guide nucleotide sequences listed in Tables 3-5 and 8-9 (SEQ ID NO: 381-657).

In some embodiments, the C to T change modifies a splicing site in the non-coding region of the CCR5-encoding polynucleotide. In one embodiment, the C to T change modifies at an intron-exon junction. In another embodiment, the C to T change modifies a splicing donor site. In another embodiment, the C to T change modifies a splicing acceptor site. In certain embodiments, the C to T changes occurs at a C base-paired with the G base in a start codon (AUG). In some embodiments, the C to T change prevents CCR5 mRNA maturation or abrogates CCR5 expression.

In some embodiments, the C to T change is selected from the C to T changes listed in Table 2, 8, or 9. In certain embodiments, the guide nucleotide sequence is selected from the guide nucleotide sequences (SEQ ID NOs: 577-657) listed in Tables 8 and 9.

In some embodiments, the C to T change results in a codon change in the CCR5-encoding polynucleotide listed in Table 7. In certain embodiments, a PAM sequence is located 3' of the C being changed. In certain embodiments, a PAM sequence is located 5' of the C being changed. In specific embodiments, the PAM sequence is selected from the group consisting of: NGG, NGAN, NGNG, NGAG, NGCG, NNGRRT, NGRRN, NNNRRT, NNNGATT, NNAGAA, NAAAC, NNT, NNNT, and YNT, wherein Y is pyrimidine, R is purine, and N is any nucleobase.

In some embodiments, no PAM sequence is located 3' of the C being changed. In some embodiments, no PAM sequence is located 5' of the C being changed. In certain embodiments, no PAM sequence is located 5' or 3' of the C being changed. In some embodiments, at least 1, 2, 3, 4, 5, 6, 7, 8, 9, or 10 mutations are introduced into the CCR5-encoding polynucleotide. In certain embodiments, the guide nucleotide sequence is RNA (guide RNA or gRNA). In some embodiments, the guide nucleotide sequence is ssDNA (guide DNA or gDNA).

In some aspects, the disclosure provides a method of editing a polynucleotide encoding a C—C chemokine receptor type 2 (CCR2) protein, the method comprising contacting the CCR2-encoding polynucleotide with: (i) a fusion protein comprising: (a) a guide nucleotide sequence-programmable DNA binding protein domain; and (b) a cytosine deaminase domain; and (ii) a guide nucleotide sequence targeting the fusion protein of (i) to a target cytosine (C) base in the CCR2-encoding polynucleotide, wherein the contacting results in the deamination of the target C base by the fusion protein, resulting in a cytosine-guanine (C:G) to thymine-adenine pair (T:A) change in the CCR2-encoding polynucleotide. In some embodiments, the fusion protein of (i) comprises a Gam protein.

In some embodiments, the C to T change is in the coding sequence of the CCR2-encoding polynucleotide. In some embodiments, the C to T change leads to leads to a mutation in the CCR2 protein.

In some embodiments, the mutation in the CCR2 protein is a loss-of-function mutation. In certain embodiments, the mutation is selected from the mutations listed in Table 1.

In certain embodiments, the method is carried out in vitro. In some embodiments, the method is carried out in a cultured cell. In some embodiments, the method is carried out in vivo. In other embodiments, the method is carried out ex vivo.

In certain embodiments, the method is carried out in a mammal. In some embodiments, the mammal is a rodent. In some embodiments, the mammal is a primate. In some embodiments, the mammal is human.

In some aspects, the disclosure provides a method of editing a polynucleotide encoding a C—C chemokine receptor type five (CCR2) protein, the method comprising contacting the CCR2-encoding polynucleotide with: (i) a fusion protein comprising: (a) a guide nucleotide sequence-programmable DNA binding protein domain; and (b) a cytosine deaminase domain; and (ii) a guide nucleotide sequence targeting the fusion protein of (i) to a target cytosine (C) base in the CCR2-encoding polynucleotide; wherein the target C base is deaminated by the fusion protein, resulting in a cytosine-guanine pair (C:G) to thymine-adenine pair (T:A) change in the CCR2-encoding polynucleotide. In some embodiments, the fusion protein of (i) comprises a Gam protein.

In some embodiments, the guide nucleotide sequence-programmable DNA binding protein domain is selected from the group consisting of: a nuclease inactive Cas9 (dCas9) domain, a nuclease inactive Cpf1 domain, a nuclease inactive Argonaute domain, and variants and combinations thereof. In certain embodiments, the guide nucleotide sequence-programmable DNA-binding protein domain comprises a nuclease inactive Cas9 (dCas9) domain.

In some embodiments, the amino acid sequence of the dCas9 domain comprises mutations corresponding to D10A and/or H840A mutation(s) in SEQ ID NO: 1. In specific embodiments, the amino acid sequence of the dCas9 domain comprises a mutation corresponding to a D10A mutation in SEQ ID NO: 1, and wherein the dCas9 domain comprises a histidine at the position corresponding to amino acid 840 of SEQ ID NO: 1. In some embodiments, the guide nucleotide sequence-programmable DNA-binding protein domain comprises a nuclease inactive Cpf1 (dCpf1) domain. In a specific embodiment, the dCpf1 domain is from a species of *Acidaminococcus* or Lachnospiraceae. In some embodiments, the guide nucleotide sequence-programmable DNA-binding protein domain comprises a nuclease inactive Argonaute (dAgo) domain. In an embodiment, the dAgo domain is from *Natronobacterium gregoryi*.

As a set of non limiting examples, any of the fusion proteins described herein that include a Cas9 domain can use another guide nucleotide sequence-programmable DNA binding protein, such as CasX, CasY, Cpf1, C2c1, C2c2, C2c3, and Argonaute, in place of the Cas9 domain. These may be nuclease inactive variants of the proteins. Guide nucleotide sequence-programmable DNA binding protein include, without limitation, Cas9 (e.g., dCas9 and nCas9), saCas9 (e.g., saCas9d, saCas9n, and saKKH Cas9), CasX, CasY, Cpf1, C2c1, C2c2, C2C3, Argonaute, and any of suitable protein described herein. In some embodiments, the fusion protein described herein comprises a Gam protein, a guide nucleotide sequence-programmable DNA binding protein, and a cytidine deaminase domain.

In some embodiments, the cytosine deaminase domain comprises an apolipoprotein B mRNA-editing complex (APOBEC) family deaminase. In specific embodiments, the cytosine deaminase is selected from the group consisting of APOBEC1, APOBEC2, APOBEC3A, APOBEC3B, APOBEC3C, APOBEC3D, APOBEC3F, APOBEC3G deaminase, APOBEC3H deaminase, APOBEC4 deaminase, activation-induced deaminase (AID), and pmCDA1. In an embodiment, the cytosine deaminase comprises an amino acid sequence of any one of SEQ ID NOs: 270-292.

In some embodiments, the fusion protein of (a) further comprises a uracil glycosylase inhibitor (UGI) domain. In certain embodiments, the cytosine deaminase domain is fused to the N-terminus of the guide nucleotide sequence-programmable DNA-binding protein domain. In specific embodiments, the UGI domain is fused to the C-terminus of the guide nucleotide sequence-programmable DNA-binding protein domain. In some embodiments, the cytosine deaminase and the guide nucleotide sequence-programmable DNA-binding protein domain are fused via an optional linker. In an embodiment, the UGI domain is fused to the dCas9 domain via an optional linker.

In certain embodiments, the fusion protein comprises the structure NH$_2$-[cytosine deaminase domain]-[optional linker sequence]-[guide nucleotide sequence-programmable DNA-binding protein domain]-[optional linker sequence]-[UGI domain]-COOH.

In some embodiments, the linker comprises (GGGS)$_n$ (SEQ ID NO: 303), (GGGGS)$_n$ (SEQ ID NO: 304), (G)$_n$ (EAAAK)$_n$ (SEQ ID NO: 305), (GGS), SGSETPGTSESATPES (SEQ ID NO: 306), or (XP)$_n$ motif, or a combination of any of these, wherein n is independently an integer between 1 and 30, and wherein X is any amino acid. In an embodiment, linker comprises the amino acid sequence SGSETPGTSESATPES (SEQ ID NO: 306). In some embodiments, the linker is (GGS), and wherein n is 1, 3, or 7.

In some aspects, the instant disclosure provides a composition comprising: (i) a fusion protein comprising: (a) a guide nucleotide sequence-programmable DNA binding protein domain; and (b) a cytosine deaminase domain; and (ii) a guide nucleotide sequence targeting the fusion protein of (i) to a polynucleotide encoding a C—C chemokine receptor type five (CCR5) protein. In some embodiments, the fusion protein of (i) comprises a Gam protein.

In some aspects, the instant disclosure provides a composition comprising: (i) a fusion protein comprising: (a) a guide nucleotide sequence-programmable DNA binding protein domain; and (b) a cytosine deaminase domain; and (ii) a guide nucleotide sequence targeting the fusion protein of (i) to a polynucleotide encoding a C—C chemokine receptor type two (CCR2) protein. In some embodiments, the fusion protein of (i) comprises a Gam protein.

In some aspects, the instant disclosure provides a composition comprising: (i) a fusion protein comprising: (a) a guide nucleotide sequence-programmable DNA binding protein domain; and (b) a cytosine deaminase domain; (ii) a guide nucleotide sequence targeting the fusion protein of (i) to a polynucleotide encoding a C—C chemokine receptor type five (CCR5) protein; and (iii) a guide nucleotide sequence targeting the fusion protein of (i) to a polynucleotide encoding a C—C chemokine receptor type 2 (CCR2) protein. In some embodiments, the fusion protein of (i) comprises a Gam protein.

In some embodiments, the guide nucleotide sequence of (ii) is selected from SEQ ID NOs: 381-657.

In certain embodiments, the composition further comprises a pharmaceutically acceptable carrier.

In some embodiments, the instant disclosure provides a method of reducing the binding of gp120 and CCR5 in a subject, the method comprising administering to a subject in need thereof a therapeutically effective amount of a composition of the instant disclosure.

In some embodiments, the instant disclosure provides a method of reducing virus binding to CCR5 in a subject, the method comprising administering to a subject in need thereof a therapeutically effective amount of the composition of the instant disclosure.

In some embodiments, the instant disclosure provides a method of reducing viral infection in a subject, the method comprising administering to a subject in need thereof a therapeutically effective amount of a composition of the instant disclosure.

In some embodiments, the instant disclosure provides a method of reducing functional CCR5 receptors on a cell in a subject, the method comprising administering to a subject in need thereof a therapeutically effective amount of the composition of the instant disclosure.

In some embodiments, the cell is selected from the group consisting of: macrophage, dendritic cell, memory T cell, endothelial cell, epithelial cell, vascular smooth muscle cell, fibroblast, microglia, neuron, and astrocyte.

In some embodiments, the instant disclosure provides a treating a condition, the method comprising administering to a subject in need thereof a therapeutically effective amount of a composition provided by the instant disclosure, wherein the condition is human immunodeficiency virus (HIV) infection, acquired immune deficiency syndrome (AIDS), an immunologic disease, or a combination thereof.

In one embodiment, the condition is human immunodeficiency virus (HIV) infection.

In some embodiments, the instant disclosure provides a method of preventing a condition, the method comprising administering to a subject in need thereof a therapeutically effective amount of a composition provided in the instant disclosure, wherein the condition is human immunodeficiency virus (HIV) infection, acquired immune deficiency syndrome (AIDS), an immunologic disease, or a combination thereof.

In certain embodiments, the condition is human immunodeficiency virus (HIV) infection.

In some embodiments, the instant disclosure provides a kit comprising a composition provided in the instant disclosure.

The summary above is meant to illustrate, in a non-limiting manner, some of the embodiments, advantages, features, and uses of the technology disclosed herein. Other embodiments, advantages, features, and uses of the technology disclosed herein will be apparent from the Detailed Description, the Drawings, the Examples, and the Claims. The details of certain embodiments of the disclosure are set forth in the Detailed Description of Certain Embodiments, as described below. Other features, objects, and advantages of the presented compositions and methods will be apparent from the Definitions, Examples, Figures, and Claims.

BRIEF DESCRIPTION OF THE DRAWINGS

The accompanying drawings, which constitute a part of this specification, illustrate several embodiments of the invention and together with the description, serve to explain the principles of the invention.

DEFINITIONS

Figure 1:
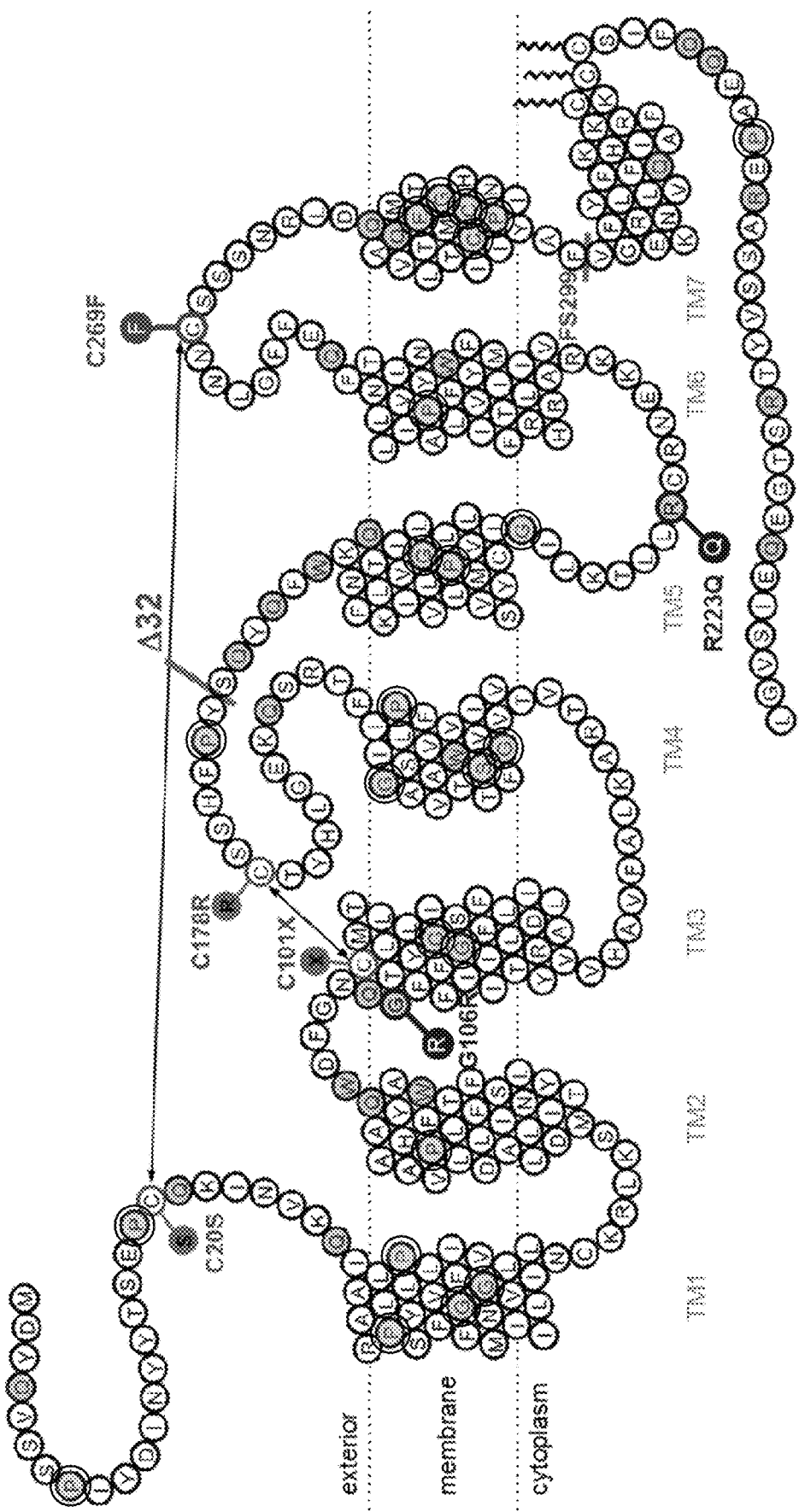
FIG. 1 depicts a CCR5 protein structure which shows HIV-protective variants (C20S, C101X, G106R, C178R, Δ32, R223Q, C269F, and FS299) that can be replicated or imitated using genome/base-editing with FIG. 5 is a graphic representation of C to T editing of CCR5 target DNA (SEQ ID NO: 738) in HEK293 cells using KKH-SaBE3 and guide-RNA Q186X-e. The editing was calculated from total reads (MiSeq). Panel A demonstrates that significant editing was observed at position C7 and C13 of SEQ ID NO: 739 (complementary nucleotide sequence is SEQ ID NO: 741), both of which generate premature stop codons in tandem (Q186X and Q188X, see inset graphic of panel A and amino acid sequence of SEQ ID NO: 740). The PAM sequence (SEQ ID NO: 736) is shown as underlined and the last nucleotide of the protospacer (SEQ ID NO: 735) is separated with a line. Raw data used for base-calling and calculating base-editing for KKH-BE3 and Q186X-e treated HEK293 cells is shown in panel B. The indel percentage was 1.97%. Panel C shows raw data collected for untreated control cells.

As used herein and in the claims, the singular forms "a," "an," and "the" include the singular and the plural reference unless the context clearly indicates otherwise. Thus, for example, a reference to "an agent" includes a single agent and a plurality of such agents.

As used herein, the term "C—C Chemokine Receptor 2" (also referred to as "C—C Chemokine Receptor type 2," "CCR2," "CCR-2," "cluster of differentiation 192," and "CD192") is a chemokine receptor encoded by the CCR2 gene. The CCR2 gene encodes two isoforms of the CCR2 protein, which is expressed on peripheral blood monocytes, activated T cells, B cells, and immature dendritic cells. Known ligands for CCR2 include the monocyte chemotactic proteins (MCPs) MCP-1, -2 and -3, which belong to the family of C—C chemokines.

As used herein, "C—C Chemokine Receptor 5" (also referred to as "C—C Chemokine Receptor type 5," "CCR5," "CCR-5," "cluster of differentiation-195," and "CD195," is a member of the beta chemokine receptor family. This protein is expressed by macrophages, dendritic cells, and memory T cells of the immune system; endothelila cells, epithelial cells, vascular smooth muscle cells, and fibroblasts; and microglia, neurons, and astrocytes in the central nervous system. See, e.g., Barmania and Pepper, Applied & Translational Genomics 2 (2013) 3-16, which is incorporated herein by reference.

The term "effective amount," as used herein, refers to an amount of a biologically active agent that is sufficient to elicit a desired biological response. For example, in some embodiments, an effective amount of a nuclease may refer to the amount of the nuclease that is sufficient to induce cleavage of a target site specifically bound and cleaved by the nuclease. In some embodiments, an effective amount of a fusion protein provided herein, e.g., of a fusion protein comprising a nuclease-inactive Cas9 domain and a nucleic acid-editing domain (e.g., a deaminase domain) may refer to the amount of the fusion protein that is sufficient to induce editing of a target site specifically bound and edited by the fusion protein. As will be appreciated by the skilled artisan, the effective amount of an agent, e.g., a fusion protein, a deaminase, a hybrid protein, a protein dimer, a complex of a protein (or protein dimer) and a polynucleotide, or a polynucleotide, may vary depending on various factors, such as, for example, on the desired biological response, e.g., on the specific allele, genome, or target site to be edited, on the cell or tissue being targeted, and/or on the agent being used.

The term "Gam protein," as used herein, refers generally to proteins capable of binding to one or more ends of a double strand break of a double stranded nucleic acid (e.g., double stranded DNA). In some embodiments, the Gam protein prevents or inhibits degradation of one or more strands of a nucleic acid at the site of the double strand break. In some embodiments, a Gam protein is a naturally-occurring Gam protein from bacteriophage Mu, or a non-naturally occurring variant thereof.

The term "loss-of-function mutation" or "inactivating mutation" refers to a mutation that results in the gene product having less or no function (being partially or wholly inactivated). When the allele has a complete loss of function (null allele), it is often called an amorphic mutation in the Muller's morphs schema. Phenotypes associated with such mutations are most often recessive. Exceptions are when the organism is haploid, or when the reduced dosage of a normal gene product is not enough for a normal phenotype (this is called haploinsufficiency).

The term "gain-of-function mutation" or "activating mutation" refers to a mutation that changes the gene product such that its effect gets stronger (enhanced activation) or even is superseded by a different and abnormal function. A gain of function mutation may also be referred to as a neomorphic mutation. When the new allele is created, a heterozygote containing the newly created allele as well as the original will express the new allele, genetically defining the mutations as dominant phenotypes.

The terms "treatment," "treat," and "treating" refer to a clinical intervention aimed to reverse, alleviate, delay the onset of, or inhibit the progress of a disease or disorder, or one or more symptoms thereof, as described herein. In some embodiments, treatment may be administered after one or more symptoms have developed and/or after a disease has been diagnosed. Treatment may also be continued after symptoms have resolved, for example, to prevent or delay their recurrence. In one embodiment, the methods and compositions disclosed herein may be used to delay the onset of AIDS in an individual infected with HIV. The terms "prevention," "prevent," and "preventing" refer to a clinical intervention aimed to inhibit the onset of a disease or disorder, or one or more symptoms thereof, as described herein. In one embodiment, treatment may be administered in the absence of symptoms, e.g., to prevent or delay onset of a symptom or inhibit onset or progression of a disease. In one embodiment, the methods and compositions disclosed herein may be used to prevent infection of a subject with HIV. In one example, treatment may be administered to a susceptible individual prior to the onset of symptoms (e.g., in light of a history of symptoms and/or in light of genetic or other susceptibility factors) in order to prevent the onset of the disease or symptoms of the disease.

The term "genome" refers to the genetic material of a cell or organism. It typically includes DNA (or RNA in the case of RNA viruses). The genome includes both the genes, the coding regions, the noncoding DNA, and the genomes of the mitochondria and chloroplasts. A genome does not typically include genetic material that is artificially introduced into a cell or organism, e.g., a plasmid that is transformed into a bacteria is not a part of the bacterial genome.

A "programmable DNA-binding protein" refers to DNA binding proteins that can be programmed to target any desired nucleotide sequence within a genome. To program the DNA-binding protein to bind a desired nucleotide sequence, the DNA binding protein may be modified to change its binding specificity, e.g., zinc finger nuclease (ZFN) or transcription activator-like effector proteins (TALE). ZFNs are artificial restriction enzymes generated by fusing a zinc finger DNA-binding domain to a DNA-cleavage domain. Zinc finger domains can be engineered to target specific desired DNA sequences and this enables zinc-fingers to bind unique sequences within complex genomes. Transcription activator-like effector nucleases (TALEN) are engineered restriction enzymes that can be engineered to cut specific sequences of DNA. They are made by fusing a TAL effector DNA-binding domain to a nuclease domain (e.g., Fok1). Transcription activator-like effectors (TALEs) can be engineered to bind practically any desired DNA sequence. Methods for programming ZFNs and TALEs are familiar to one skilled in the art. For example, such methods are described in Maeder, et al., Mol. Cell 31 (2): 294-301, 2008; Carroll et al., Genetics Society of America, 188 (4): 773-782, 2011; Miller et al., Nature Biotechnology 25 (7): 778-785, 2007; Christian et al., Genetics 186 (2): 757-61, 2008; Li et al., Nucleic Acids Res 39 (1): 359-372, 2010; and Moscou et al., Science 326 (5959): 1501, 2009, the entire contents of each of which are incorporated herein by reference.

A "guide nucleotide sequence-programmable DNA-binding protein" refers to a protein, a polypeptide, or a domain that is able to bind DNA, and the binding to its target DNA sequence is mediated by a guide nucleotide sequence. Thus, it is appreciated that the guide nucleotide sequence-programmable DNA-binding protein binds to a guide nucleotide sequence. The "guide nucleotide" may be an RNA or DNA molecule (e.g., a single-stranded DNA or ssDNA molecule) that is complementary to the target sequence and can guide the DNA binding protein to the target sequence. As such, a guide nucleotide sequence-programmable DNA-binding protein may be a RNA-programmable DNA-binding protein (e.g., a Cas9 protein), or an ssDNA-programmable DNA-binding protein (e.g., an Argonaute protein). "Programmable" means the DNA-binding protein may be programmed to bind any DNA sequence that the guide nucleotide targets. Exemplary guide nucleotide sequence-programmable DNA-binding proteins include, but are not limited to, Cas9 (e.g., dCas9 and nCas9), saCas9 (e.g., saCasd, saCasn, and saKKH Cas9), CasX, CasY, Cpf1, C2c1, C2c2, C2c3, Argonaute, and any other suitable protein described herein. In some embodiments, the fusion protein described herein comprises a Gam protein, a guide nucleotide sequence-programmable DNA binding protein, and a cytidine deaminase domain.

In some embodiments, the guide nucleotide sequence exists as a single nucleotide molecule and comprises comprise two domains: (1) a domain that shares homology to a target nucleic acid (e.g., and directs binding of a guide nucleotide sequence-programmable DNA-binding protein to the target); and (2) a domain that binds a guide nucleotide sequence-programmable DNA-binding protein. In some embodiments, domain (2) corresponds to a sequence known as a tracrRNA, and comprises a stem-loop structure. For example, in some embodiments, domain (2) is identical or homologous to a tracrRNA as provided in Jinek et al., Science 337:816-821(2012), which is incorporated herein by reference. Other examples of gRNAs (e.g., those including domain (2)) can be found in U.S. Patent Application Publication US20160208288 and U.S. Patent Application Publication US20160200779, each of which is herein incorporated by reference.

Because the guide nucleotide sequence hybridizes to a target DNA sequence, the guide nucleotide sequence-programmable DNA-binding proteins are able to specifically bind, in principle, to any sequence complementary to the guide nucleotide sequence. Methods of using guide nucleotide sequence-programmable DNA-binding protein, such as Cas9, for site-specific cleavage (e.g., to modify a genome) are known in the art (see e.g., Cong, L. et al. Multiplex genome engineering using CRISPR/Cas systems. *Science* 339, 819-823 (2013); Mali, P. et al. RNA-guided human genome engineering via Cas9. *Science* 339, 823-826 (2013); Hwang, W. Y. et al. Efficient genome editing in zebrafish using a CRISPR-Cas system. *Nature biotechnology* 31, 227-229 (2013); Jinek, M. et al. RNA-programmed genome editing in human cells. *eLife* 2, e00471 (2013); Dicarlo, J. E. et al. Genome engineering in *Saccharomyces cerevisiae* using CRISPR-Cas systems. *Nucleic acids research* (2013); Jiang, W. et al. RNA-guided editing of bacterial genomes using CRISPR-Cas systems. *Nature biotechnology* 31, 233-239 (2013); the entire contents of each of which are incorporated herein by reference).

As used herein, the term "Cas9" or "Cas9 nuclease" refers to an RNA-guided nuclease comprising a Cas9 protein, fragment, or variant thereof. A Cas9 nuclease is also referred to sometimes as a casn1 nuclease or a CRISPR (clustered regularly interspaced short palindromic repeat)-associated nuclease. CRISPR is an adaptive immune system that provides protection against mobile genetic elements (viruses, transposable elements, and conjugative plasmids). CRISPR clusters contain spacers, sequences complementary to antecedent mobile elements, and target invading nucleic acids. CRISPR clusters are transcribed and processed into CRISPR RNA (crRNA). In type II CRISPR systems correct processing of pre-crRNA requires a trans-encoded small RNA (tracrRNA), endogenous ribonuclease 3 (rnc) and a Cas9 protein. The tracrRNA serves as a guide for ribonuclease 3-aided processing of pre-crRNA. Subsequently, Cas9/crRNA/tracrRNA endonucleolytically cleaves linear or circular dsDNA target complementary to the spacer. The target strand not complementary to crRNA is first cut endonucleolytically, then trimmed 3'-5' exonucleolytically. In nature, DNA-binding and cleavage typically requires protein and both RNAs. However, single guide RNAs ("sgRNA", or simply "gNRA") can be engineered so as to incorporate aspects of both the crRNA and tracrRNA into a single RNA species. See, e.g., Jinek et al., *Science* 337:816-821(2012), which is incorporated herein by reference.

Cas9 nuclease sequences and structures are known to those of skill in the art (see, e.g., Ferretti et al., *Proc. Natl. Acad. Sci.* 98:4658-4663(2001); Deltcheva E. et al., *Nature* 471:602-607(2011); and Jinek et al., *Science* 337:816-821 (2012), the entire contents of each of which are incorporated herein by reference). Cas9 orthologs have been described in various species, including, but not limited to, *S. pyogenes* and *S. thermophilus*. Additional suitable Cas9 nucleases and sequences will be apparent to those of skill in the art based on this disclosure, and such Cas9 nucleases and sequences include Cas9 sequences from the organisms and loci disclosed in Chylinski et al., (2013) RNA Biology 10:5, 726-737; which is incorporated herein by reference. In some embodiments, wild type Cas9 corresponds to Cas9 from *Streptococcus pyogenes* (NCBI Reference Sequence: NC_002737.2, SEQ ID NO: 4 (nucleotide); and Uniprot Reference Sequence: Q99ZW2, SEQ ID NO: 1 (amino acid).

Streptococcus pyogenes Cas9 (wild type) nucleotide sequence
(SEQ ID NO: 4)
ATGGATAAGAAATACTCAATAGGCTTAGATATCGGCACAAATAGCGTCGG

ATGGGCGGTGATCACTGATGAATATAAGGTTCCGTCTAAAAAGTTCAAGG

TTCTGGGAAATACAGACCGCCACAGTATCAAAAAAAATCTTATAGGGGCT
CTTTTATTTGACAGTGGAGAGACAGCGGAAGCGACTCGTCTCAAACGGAC
AGCTCGTAGAAGGTATACACGTCGGAAGAATCGTATTTGTTATCTACAGG
AGATTTTTTCAAATGAGATGGCGAAAGTAGATGATAGTTTCTTTCATCGA
CTTGAAGAGTCTTTTTTGGTGGAAGAAGACAAGAAGCATGAACGTCATCC
TATTTTTGGAAATATAGTAGATGAAGTTGCTTATCATGAGAAATATCCAA
CTATCTATCATCTGCGAAAAAAATTGGTAGATTCTACTGATAAAGCGGAT
TTGCGCTTAATCTATTTGGCCTTAGCGCATATGATTAAGTTTCGTGGTCA
TTTTTTGATTGAGGGAGATTTAAATCCTGATAATAGTGATGTGGACAAAC
TATTTATCCAGTTGGTACAAACCTACAATCAATTATTTGAAGAAAACCCT
ATTAACGCAAGTGGAGTAGATGCTAAAGCGATTCTTTCTGCACGATTGAG
TAAATCAAGACGATTAGAAAATCTCATTGCTCAGCTCCCCGGTGAGAAGA
AAAATGGCTTATTTGGGAATCTCATTGCTTTGTCATTGGGTTTGACCCCT
AATTTTAAATCAAATTTTGATTTGGCAGAAGATGCTAAATTACAGCTTTC
AAAAGATACTTACGATGATGATTTAGATAATTTATTGGCGCAAATTGGAG
ATCAATATGCTGATTTGTTTTTGGCAGCTAAGAATTTATCAGATGCTATT
TTACTTTCAGATATCCTAAGAGTAAATACTGAATAACTAAGGCTCCCCT
ATCAGCTTCAATGATTAAACGCTACGATGAACATCATCAAGACTTGACTC
TTTTAAAAGCTTTAGTTCGACAACAACTTCCAGAAAAGTATAAAGAAATC
TTTTTTGATCAATCAAAAAACGGATATGCAGGTTATATTGATGGGGGAGC
TAGCCAAGAAGAATTTATAAATTTATCAAACCAATTTTAGAAAAAATGG
ATGGTACTGAGGAATTATTGGTGAAACTAAATCGTGAAGATTTGCTGCGC
AAGCAACGGACCTTTGACAACGGCTCTATTCCCCATCAAATTCACTTGGG
TGAGCTGCATGCTATTTTGAGAAGACAAGAAGACTTTTATCCATTTTTAA
AAGACAATCGTGAGAAGATTGAAAAAATCTTGACTTTTCGAATTCCTTAT
TATGTTGGTCCATTGGCGCGTGGCAATAGTCGTTTTGCATGGATGACTCG
GAAGTCTGAAGAAACAATTACCCCATGGAATTTTGAAGAAGTTGTCGATA
AAGGTGCTTCAGCTCAATCATTTATTGAACGCATGACAAACTTTGATAAA
AATCTTCCAAATGAAAAGTACTACCAAAACATAGTTTGCTTTATGAGTA
TTTTACGGTTTATAACGAATTGACAAAGGTCAAATATGTTACTGAAGGAA
TGCGAAAACCAGCATTTCTTTCAGGTAACAGAAGAAAGCCATTGTTGAT
TTACTCTTCAAAACAAATCGAAAGTAACCGTTAAGCAATTAAAAGAAGA
TTATTTCAAAAAATAGAATGTTTTGATAGTGTTGAAATTTCAGGAGTTG
AAGATAGATTTAATGCTTCATTAGGTACCTACCATGATTTGCTAAAAATT
ATTAAAGATAAAGATTTTTGGATAATGAAGAAATGAAGATATCTTAGA
GGATATTGTTTTAACATTGACCTTATTTGAAGATAGGGAGATGATTGAGG
AAAGACTTAAAACATATGCTCACCTCTTTGATGATAAGGTGATGAAACAG
CTTAAACGTCGCCGTTATACTGGTTGGGGACGTTTGTCTCGAAAATTGAT
TAATGGTATTAGGGATAAGCAATCTGGCAAAACAATATTAGATTTTTGA
AATCAGATGGTTTTGCCAATCGCAATTTTATGCAGCTGATCCATGATGAT

AGTTTGACATTTAAAGAAGACATTCAAAAAGCACAAGTGTCTGGACAAGG
CGATAGTTTACATGAACATATTGCAAATTTAGCTGGTAGCCCTGCTATTA
AAAAAGGTATTTTACAGACTGTAAAAGTTGTTGATGAATTGGTCAAAGTA
ATGGGGCGGCATAAGCCAGAAAATATCGTTATTGAAATGGCACGTGAAAA
TCAGACAACTCAAAAGGGCCAGAAAAATTCGCGAGAGCGTATGAAACGAA
TCGAAGAAGGTATCAAAGAATTAGGAAGTCAGATTCTTAAAGAGCATCCT
GTTGAAAATACTCAATTGCAAATGAAAAGCTCTATCTCTATTATCTCCA
AAATGGAAGAGACATGTATGTGGACCAAGAATTAGATATTAATCGTTTAA
GTGATTATGATGTCGATCACATTGTTCCACAAAGTTTCCTTAAAGACGAT
TCAATAGACAATAAGGTCTTAACGCGTTCTGATAAAAATCGTGGTAAATC
GGATAACGTTCCAAGTGAAGAAGTAGTCAAAAAGATGAAAAACTATTGGA
GACAACTTCTAAACGCCAAGTTAATCACTCAACGTAAGTTTGATAATTTA
ACGAAAGCTGAACGTGGAGGTTTGAGTGAACTTGATAAAGCTGGTTTTAT
CAAACGCCAATTGGTTGAAACTCGCCAAATCACTAAGCATGTGGCACAAA
TTTTGGATAGTCGCATGAATACTAAATACGATGAAAATGATAAACTTATT
CGAGAGGTTAAAGTGATTACCTTAAAATCTAAATTAGTTTCTGACTTCCG
AAAAGATTTCCAATTCTATAAAGTACGTGAGATTAACAATTACCATCATG
CCCATGATGCGTATCTAAATGCCGTCGTTGGAACTGCTTTGATTAAGAAA
TATCCAAAACTTGAATCGGAGTTTGTCTATGGTGATTATAAAGTTTATGA
TGTTCGTAAAATGATTGCTAAGTCTGAGCAAGAAATAGGCAAAGCAACCG
CAAAATATTTCTTTTACTCTAATATCATGAACTTCTTCAAAACAGAAATT
ACACTTGCAAATGGAGAGATTCGCAAACGCCCTCTAATCGAAACTAATGG
GGAAACTGGAGAAATTGTCTGGGATAAAGGGCGAGATTTTGCCACAGTGC
GCAAAGTATTGTCCATGCCCCAAGTCAATATTGTCAAGAAAACAGAAGTA
CAGACAGGCGGATTCTCCAAGGAGTCAATTTTACCAAAAAGAAATTCGGA
CAAGCTTATTGCTCGTAAAAAAGACTGGGATCCAAAAAAATATGGTGGTT
TTGATAGTCCAACGGTAGCTTATTCAGTCCTAGTGGTTGCTAAGGTGGAA
AAAGGGAAATCGAAGAAGTTAAAATCCGTTAAAGAGTTACTAGGGATCAC
AATTATGGAAAGAAGTTCCTTTGAAAAAAATCCGATTGACTTTTTAGAAG
CTAAAGGATATAAGGAAGTTAAAAAAGACTTAATCATTAAACTACCTAAA
TATAGTCTTTTTGAGTTAGAAAACGGTCGTAAACGGATGCTGGCTAGTGC
CGGAGAATTACAAAAAGGAAATGAGCTGGCTCTGCCAAGCAAATATGTGA
ATTTTTTATATTTAGCTAGTCATTATGAAAAGTTGAAGGGTAGTCCAGAA
GATAACGAACAAAAACAATTGTTTGTGGAGCAGCATAAGCATTATTTAGA
TGAGATTATTGAGCAAATCAGTGAATTTTCTAAGCGTGTTATTTTAGCAG
ATGCCAATTTAGATAAAGTTCTTAGTGCATATAACAAACATAGAGACAAA
CCAATACGTGAACAAGCAGAAAATATTATTCATTTATTTACGTTGACGAA
TCTTGGAGCTCCCGCTGCTTTTAAATATTTTGATACAACAATTGATCGTA
AACGATATACGTCTACAAAAGAAGTTTTAGATGCCACTCTTATCCATCAA
TCCATCACTGGTCTTTATGAAACACGCATTGATTTGAGTCAGCTAGGAGG
TGACTGA

*Streptococcus pyogenes* Cas9 (wild type) protein sequence (SEQ ID NO: 1)
MDKK<u>YSIGLDIGTNSVGWAVITDEYKVPSKKFKVLGNTDRHSIKKNLIGA</u>

<u>LLFDSGET</u>AEATRLKRTARRRYTRRKNRICYLQEIFSNEMAKVDDSFF

HRLEESFLVEEDKKHERHPIFGNIVDEVAYHEKYPTIYHLRKKLV

DSTDKADLRLIYLALAHMIKFRGHFLIEGDLNPDNSDVDKLFIQLVQT

YNQLFEENPINASGVDAKAILSARLSKSRRLENLIAQLPGEKKNGLFG

NLIALSLGLTPNFKSNFDLAEDAKLQLSKDTYDDDLDNLLAQIGDQYA

DLFLAAKNLSDAILLSDILRVNTEITKAPLSASMIKRYDEHHQDLTLL

KALVRQQLPEKYKEIFFDQSKNGYAGYIDGGASQEEFYKFIKPILEKMD

GTEELLVKLNREDLLRKQRTFDNGSIPHQIHLGELHAILRRQEDFYPFL

KDNREKIEKILTFRIPYYVGPLARGNSRFAWMTRKSEETITPWNFEEVV

DKGASAQSFIERMTNFDKNLPNEKVLPKHSLLYEYFTVYNELTKVKYVT

EGMRKPAFLSGEQKKAIVDLLFKTNRKVTVKQLKEDYFKKIECFDSVEI

SGVEDRFNASLGTYHDLLKIIKDKDFLDNEENEDILEDIVLTLTLFEDR

EMIEERLKTYAHLFDDKVMKQLKRRRYTGWGRLSRKLINGIRDKQSGKT

ILDFLKSDGFANRNFMQLIHDDSLTFKEDIQKAQVSGQG<u>DSLHEHIANL</u>

<u>AGSPAIKKGILQTVKVVDELVKVMGRHKPENIVIEMARENQTTQK</u>GQK

NSRERMKRIEEGIKELGSQILKEHPVENTQLQNEKLYLYYLQNGRDMYVD

QELDINRLSDYDVDHIVPQSFLKDDSIDNKVLTRSDKNRGKSDNVPSLE

VVKKMKNYWRQLLNAKLITQRKFDNLTKAERGGLSELDKAGFIKRQLVET

RQITKHVAQILDSRMNTKYDENDKLIREVKVITLKSKLVSDFRKDFQFY

KVREINNYHHAHDAYLNAVVGTALIKKYPKLESEFVYGDYKVYDVRKMI

AKSEQEIGKATAKYFFYSNIMNFFKTEITLANGEIRKRPLIETNGETGE

IVWDKGRDFATVRKVLSMPQVNIVKKTEVQTGGFSKESILPKRNSDKLI

ARKKDWDPKKYGGFDSPTVAYSVLVVAKVEKGKSKKLKSVKELLGITIM

ERSSFEKNPIDFLEAKGYKEVKKDLIIKLPKYSLFELENGRKRMLASAG

ELQKGNELALPSKYVNFLYLASHYEKLKGSPEDNEQKQLFVEQHKHYLD

EIIEQISEFSKRVILADANLDKVLSAYNKHRDKPIREQAENIIHLFTLT

NLGAPAAFKYFDTTIDRKRYTSTKEVLDATLIHQSITGLYETRIDLSQL

GGD
(single underline: HNH domain; double underline: RuvC domain)

In some embodiments, wild type Cas9 corresponds to Cas9 from *Staphylococcus aureus* (NCBI Reference Sequence: WP_001573634.1, SEQ ID NO: 5 (amino acid).

*Staphylococcus aureus* Cas9 (wild type) protein sequence (SEQ ID NO: 5)
MKRNYILGLDIGITSVGYGIIDYETRDVIDAGVRLFKEANVENNEGRRSK

RGARRLKRRRRHRIQRVKKLLFDYNLLTDHSELSGINPYEARVKGLSQKL

SEEEFSAALLHLAKRRGVHNVNEVEEDTGNELSTKEQISRNSKALEEKYV

AELQLERLKKDGEVRGSINRFKTSDYVKEAKQLLKVQKAYHQLDQSFIDT

YIDLLETRRTYYEGPGEGSPFGWKDIKEWYEMLMGHCTYFPEELRSVKYA

YNADLYNALNDLNNLVITRDENEKLEYYEKFQIIENVFKQKKKPTLKQIA

KEILVNEEDIKGYRVTSTGKPEFTNLKVYHDIKDITARKEIIENAELLDQ

IAKILTIYQSSEDIQEELTNLNSELTQEEIEQISNLKGYTGTHNLSLKAI

NLILDELWHTNDNQIAIFNRLKLVPKKVDLSQQKEIPTTLVDDFILSPVV

KRSFIQSIKVINAIIKKYGLPNDIIIELAREKNSKDAQKMINEMQKRNRQ

TNERIEEIIRTTGKENAKYLIEKIKLHDMQEGKCLYSLEAIPLEDLLNNP

FNYEVDHIIPRSVSFDNSFNNKVLVKQEENSKKGNRTPFQYLSSSDSKIS

YETFKKHILNLAKGKGRISKTKKEYLLEERDINRFSVQKDFINRNLVDTR

YATRGLMNLLRSYFRVNNLDVKVKSINGGFTSFLRRKWKFKKERNKGYKH

HAEDALIIANADFIFKEWKKLDKAKKVMENQMFEEKQAESMPEIETEQEY

KEIFITPHQIKHIKDFKDYKYSHRVDKKPNRELINDTLYSTRKDDKGNTL

IVNNLNGLYDKDNDKLKKLINKSPEKLLMYHHDPQTYQKLKLIMEQYGDE

KNPLYKYYEETGNYLTKYSKKDNGPVIKKIKYYGNKLNAHLDITDDYPNS

RNKVVKLSLKPYRFDVYLDNGVYKFVTVKNLDVIKKENYYEVNSKCYEEA

KKLKKISNQAEFIASFYNNDLIKINGELYRVIGVNNDLLNRIEVNMIDIT

YREYLENMNDKRPPRIIKTIASKTQSIKKYSTDILGNLYEVKSKKHPQII

KKG

In some embodiments, wild type Cas9 corresponds to Cas9 from *Streptococcus pyogenes* (NCBI Reference Sequence: NC_017053.1, SEQ ID NO: 679 (nucleotide); SEQ ID NO: 680 (amino acid)).

(SEQ ID NO: 679)
ATGGATAAGAAATACTCAATAGGCTTAGATATCGGCACAAATAGCGTCGG

ATGGGCGGTGATCACTGATGATTATAAGGTTCCGTCTAAAAAGTTCAAGG

TTCTGGGAAATACAGACCGCCACAGTATCAAAAAAAATCTTATAGGGGCT

CTTTTATTTGGCAGTGGAGAGACAGCGGAAGCGACTCGTCTCAAACGGAC

AGCTCGTAGAAGGTATACACGTCGGAAGAATCGTATTTGTTATCTACAGG

AGATTTTTTCAAATGAGATGGCGAAAGTAGATGATAGTTTCTTTCATCGA

CTTGAAGAGTCTTTTTTGGTGGAAGAAGACAAGAAGCATGAACGTCATCC

TATTTTTGGAAATATAGTAGATGAAGTTGCTTATCATGAGAAATATCCAA

CTATCTATCATCTGCGAAAAAAATTGGCAGATTCTACTGATAAAGCGGAT

TTGCGCTTAATCTATTTGGCCTTAGCGCATATGATTAAGTTTCGTGGTCA

TTTTTTGATTGAGGGAGATTTAAATCCTGATAATAGTGATGTGGACAAAC

TATTTATCCAGTTGGTACAAATCTACAATCAATTATTTGAAGAAACCCT

ATTAACGCAAGTAGAGTAGATGCTAAAGCGATTCTTTCTGCACGATTGAG

TAAATCAAGACGATTAGAAAATCTCATTGCTCAGCTCCCGGTGAGAAGA

GAAATGGCTTGTTTGGGAATCTCATTGCTTTGTCATTGGGATTGACCCCT

AATTTTAAATCAAATTTTGATTTGGCAGAAGATGCTAAATTACAGCTTTC

AAAAGATACTTACGATGATTTAGATAATTTATTGGCGCAAATTGGAG

ATCAATATGCTGATTTGTTTTTGGCAGCTAAGAATTTATCAGATGCTATT

TTACTTTCAGATATCCTAAGAGTAAATAGTGAAATAACTAAGGCTCCCCT

```
ATCAGCTTCAATGATTAACGCTACGATGAACATCATCAAGACTTGACTCT
TTTAAAAGCTTTAGTTCGACAACAACTTCCAGAAAAGTATAAAGAAATCT
TTTTTGATCAATCAAAAAACGGATATGCAGGTATATTGATGGGGGAGCTA
GCCAAGAAGAATTTTATAAATTTATCAAACCAATTTTAGAAAAAATGGAT
GGTACTGAGGAATTATTGGTGAAACTAAATCGTGAAGATTTGCTGCGCAA
GCAACGGACCTTTGACAACGGCTCTATTCCCCATCAAATTCACTTGGGTG
AGCTGCATGCTATTTTGAGAAGACAAGAAGACTTTTATCCATTTTTAAAA
GACAATCGTGAAGATTGAAAAAATCTTGACTTTTCGAATTCCTTATTA
TGTTGGTCCATTGGCCGTGGCAATAGTCGTTTTGCATGGATGACTCGGAA
GTCTGAAGAAACAATTACCCCATGGAATTTTGAAGAAGTTGTCGATAAAG
GTGCTTCAGCTCAATCATTTATTGAACGCATGACAAACTTTGATAAAAAT
CTTCCAAATGAAAAAGTACTACCAAACATAGTTTGCTTTATGAGTATTT
TACGGTTTATAACGAATTGACAAAGGTCAAATATGTTACTGAGGGAATGC
GAAAACCAGCATTTCTTTCAGGTGAACAGAAGAAAGCCATTGTTGATTTC
TCTTCAAAACAAATCGAAAAGTAACCGTTAAGCAATTAAAAGAAGATTAT
TTCAAAAAAATAGAATGTTTTGATAGTGTTGAAATTTCAGGAGTTGAAGA
TAGATTTAATGCTTCATTAGGCGCCTACCATGATTTGCTAAAAATTATTA
AAGATAAAGATTTTTTGGATAATGAAGAAAATGAAGATATCTTAGAGGAT
ATTGTTTTAACATTGACCTTATTTGAAGATAGGGGGATGATTGAGGAAAG
ACTTAAAACATATGCTCACCTCTTTGATGATAAGGTGATGAAACAGCTTA
AACGTCGCCGTTATACTGGTTGGGGACGTTTGTCTCGAAAATTGATTAAT
GGTATTAGGGATAAGCAATCTGGCAAAACAATATTAGATTTTTTGAAATC
AGATGGTTTTGCCAATCGCAATTTTATGCAGCTGATCCATGATGATAGTT
TGACATTTAAAGAAGATATTCAAAAAGCACAGGTGTCTGGACAAGGCCAT
AGTTTACATGAACAGATTGCTAACTTAGCTGGCAGTCCTGCTATTAAAA
AGGTATTTTACAGACTGTAAAAATTGTTGATGAACTGGTCAAAGTAATGG
GGCATAAGCCAGAAAATATCGTTATTGAAATGGCACGTGAAAATCAGACA
ACTCAAAAGGGCCAGAAAAATTCGCGAGAGCGTATGAAACGAATCGAAGA
AGGTATCAAAGAATTAGGAAGTCAGATTCTTAAAGAGCATCCTGTTGAAA
ATACTCAATTGCAAAATGAAAAGCTCTATCTCTATTATCTACAAAATGGA
AGAGACATGTATGTGGACCAAGAATTAGATATTAATCGTTTAAGTGATTA
TGATGTCGATCACATTGTTCCACAAAGTTTCATTAAAGACGATTCAATAG
ACAATAAGGTACTAACGCGTTCTGATAAAAATCGTGGTAAATCGGATAAC
GTTCCAAGTGAAGAAGTAGTCAAAAAGATGAAAAACTATTGGAGACAACT
TCTAAACGCCAAGTTAATCACTCAACGTAAGTTTGATAATTTAACGAAAG
CTGAACGTGGAGGTTTGAGTGAACTTGATAAAGCTGGTTTATCAAACGC
CAATTGGTTGAAACTCGCCAAATCACTAAGCATGTGGCACAAATTTTGGA
TAGTCGCATGAATACTAAATACGATGAAAATGATAAACTTATTCGAGAGG
TTAAAGTGATTACCTTAAAATCTAAATTAGTTTCTGACTTCCGAAAAGAT
TTCCAATTCTATAAAGTACGTGAGATTAACAATTACCATCATGCCCATGA

TGCGTATCTAAATGCCGTCGTTGGAACTGCTTTGATTAAGAAATATCCAA
AACTTGAATCGGAGTTTGTCTATGGTGATTATAAAGTTTATGATGTTCGT
AAAATGATTGCTAAGTCTGAGCAAGAAATAGGCAAAGCAACCGCAAAATA
TTTCTTTTACTCTAATATCATGAACTTCTTCAAAACAGAAATTACACTTG
CAAATGGAGAGATTCGCAAACGCCCTCTAATCGAAACTAATGGGGAAACT
GGAGAAATTGTCTGGGATAAAGGGCGAGATTTTGCCACAGTGCGCAAAGT
ATTGTCCATGCCCCAAGTCAATATTGTCAAGAAAACAGAAGTACAGACAG
GCGGATTCTCCAAGGAGTCAATTTTACCAAAAAGAAATTCGGACAAGCTT
ATTGCTCGTAAAAAAGACTGGGATCCAAAAAAATATGGTGGTTTTGATAG
TCCAACGGTAGCTTATTCAGTCCTAGTGGTTGCTAAGGTGGAAAAAGGGA
AATCGAAGAAGTTAAAATCCGTTAAAGAGTTACTAGGGATCACAATTATG
GAAAGAAGTTCCTTTGAAAAAAATCCGATTGACTTTTTAGAAGCTAAAGG
ATATAAGGAAGTTAAAAAAGACTTAATCATTAAACTACCTAAATATAGTC
TTTTTGAGTTAGAAAACGGTCGTAAACGGATGCTGGCTAGTGCCGGAGAA
TTACAAAAAGGAAATGAGCTGGCTCTGCCAAGCAAATATGTGAATTTTTT
ATATTTAGCTAGTCATTATGAAAAGTTGAAGGGTAGTCCAGAAATAACGA
ACAAAAACAATTGTTTGTGGAGCAGCATAAGCATTATTTAGATGAGATTA
TTGAGCAAATCAGTGAATTTTCTAAGCGTGTTATTTTAGCAGATGCCAAT
TTAGATAAAGTTCTTAGTGCATATAACAAACATAGAGACAAACCAATACG
TGAACAAGCAGAAAATATTATTCATTTATTTACGTTGACGAATCTTGGAG
CTCCCGCTGCTTTTAAATATTTTGATACAACAATTGATCGTAAACGATAT
ACGTCTACAAAAGAAGTTTTAGATGCCACTCTTATCCATCAATCCATCAC
TGGTCTTTATGAAACACGCATTGATTTGAGTCAGCTAGGAGGTGACTGA
```
(SEQ ID NO: 680)
MDKK<u>YSIGLDIGTNSVGWAVITDDYKVPSKKFKVLGNTDRHSIKKNLIGA</u>
<u>LLFGSGET</u>AEATRLKRTARRRYTRRKNRICYLQEIFSNEMAKVDDSFFH
RLEESFLVEEDKKHERHPIFGNIVDEVAYHEKYPTIYHLRKKLADSTDK
ADLRLIYLALAHMIKFRGHFLIEGDLNPDNSDVDKLFIQLVQIYNQLFE
ENPINASRVDAKAILSARLSKSRRLENLIAQLPGEKRNGLFGNLIALSL
GLTPNFKSNFDLAEDAKLQLSKDTYDDDLDNLLAQIGDQYADLFLAAKN
LSDAILLSDILRVNSEITKAPLSASMIKRYDEHHQDLTLLKALVRQQLP
EKYKEIFFDQSKNGYAGYIDGGASQEEFYKFIKPILEKMDGTEELLVKL
NREDLLRKQRTFDNGSIPHQIHLGELHAILRRQEDFYPFLKDNREKIEK
ILTFRIPYYVGPLARGNSRFAWMTRKSEETITPWNFEEVVDKGASAQSF
IERMTNFDKNLPNEKVLPKHSLLYEYFTVYNELTKVKYVTEGMRKPAFL
SGEQKKAIVDLLFKTNRKVTVKQLKEDYFKKIECFDSVEISGVEDRFNA
SLGAYHDLLKIIKDKDFLDNEENEDILEDIVLTLTLFEDRGMIEERLKT
YAHLFDDKVMKQLKRRRYTGWGRLSRKLINGIRDKQSGKTILDFLKSDG
FANRNFMQLIHDDSLTFKEDIQKAQVSGQG<u>HSLHEQIANLAGSPAIKKG</u>
<u>ILQTVKIVDELVKVMGHKPENIVIEMAR</u>ENQTTQK<u>GQKNSRERMKRIE</u>
<u>EGIKELGSQILKEHPVENTQLQNEKLYLYYLQNGRDMYVDQELDINRLS</u>

-continued

DYDVDHIVPQSFIKDDSIDNKVLTRSDKNRGKSDNVPSEEVVKKMKNYW

RQLLNAKLITQRKFDNLTKAERGGLSELDKAGFIKRQLVETRQITKHVA

QILDSRMNTKYDENDKLIREVKVITLKSKLVSDFRKDFQFYKVREINNY

HHAHDAYLNAVVGTALIKKYPKLESEFVYGDYKVYDVRKMIAKSEQEIG

KATAKYFFYSNIMNFFKTEITLANGEIRKRPLIETNGETGEIVWDKGRD

FATVRKVLSMPQVNIVKKTEVQTGGFSKESILPKRNSDKLIARKKDWDP

KKYGGFDSPTVAYSVLVVAKVEKGKSKKLKSVKELLGITIMERSSFEKN

PIDFLEAKGYKEVKKDLIIKLPKYSLFELENGRKRMLASAGELQKGNEL

ALPSKYVNFLYLASHYEKLKGSPEDNEQKQLFVEQHKHYLDEIIEQISE

FSKRVILADANLDKVLSAYNKHRDKPIREQAENIIHLFTLTNLGAPAAF

KYFDTTIDRKRYTSTKEVLDATLIHQSITGLYETRIDLSQLGGD (single underline: HNH domain; double underline: RuvC domain)

In some embodiments, wild type Cas9 corresponds to, or comprises, *Streptococcus pyogenes* Cas9 (SEQ ID NO: 681 (nucleotide) and/or SEQ ID NO: 682 (amino acid)):

```
                                         (SEQ ID NO: 681)
ATGGATAAAAAGTATTCTATTGGTTTAGACATCGGCACTAATTCCGTTGG
ATGGGCTGTCATAACCGATGAATACAAAGTACCTTCAAAGAAATTTAAGG
TGTTGGGGAACACAGACCGTCATTCGATTAAAAAGAATCTTATCGGTGCC
CTCCTATTCGATAGTGGCGAAACGGCAGAGGCGACTCGCCTGAAACGAAC
CGCTCGGAGAAGGTATACACGTCGCAAGAACCGAATATGTTACTTACAAG
AAATTTTTAGCAATGAGATGGCCAAAGTTGACGATTCTTTCTTTCACCGT
TTGGAAGAGTCCTTCCTTGTCGAAGAGGACAAGAAACATGAACGGCACCC
CATCTTTGGAAACATAGTAGATGAGGTGGCATATCATGAAAAGTACCCAA
CGATTTATCACCTCAGAAAAAGCTAGTTGACTCAACTGATAAAGCGGAC
CTGAGGTTAATCTACTTGGCTCTTGCCCATATGATAAAGTTCCGTGGGCA
CTTTCTCATTGAGGGTGATCTAAATCCGGACAACTCGGATGTCGACAAAC
TGTTCATCCAGTTAGTACAAACCTATAATCAGTTGTTTGAAGAGAACCCT
ATAAATGCAAGTGGCGTGGATGCGAAGGCTATTCTTAGCGCCCGCCTCTC
TAAATCCCGACGGCTAGAAAACCTGATCGCACAATTACCCGGAGAGAAGA
AAAATGGGTTGTTCGGTAACCTTATAGCGCTCTCACTAGGCCTGACACCA
AATTTTAAGTCGAACTTCGACTTAGCTGAAGATGCCAAATTGCAGCTTAG
TAAGGACACGTACGATGACGATCTCGACAATCTACTGGCACAAATTGGAG
ATCAGTATGCGGACTTATTTTTGGCTGCCAAAAACCTTAGCGATGCAATC
CTCCTATCTGACATACTGAGAGTTAATACTGAGATTACCAAGGCGCCGTT
ATCCGCTTCAATGATCAAAAGGTACGATGAACATCACCAAGACTTGACAC
TTCTCAAGGCCCTAGTCCGTCAGCAACTGCCTGAGAAATATAAGGAAATA
TTCTTTGATCAGTCGAAAAACGGGTACGCAGGTTATATTGACGGCGGAGC
GAGTCAAGAGGAATTCTACAAGTTTATCAAACCCATATTAGAGAAGATGG
ATGGACGGAAGAGTTGCTTGTAAAACTCAATCGCGAAGATCTACTGCGA
AAGCAGCGGACTTTCGACAACGGTAGCATTCCACATCAAATCCACTTAGG

CGAATTGCATGCTATACTTAGAAGGCAGGAGGATTTTTATCCGTTCCTCA
AAGACAATCGTGAAAGATTGAGAAAATCCTAACCTTTCGCATACCTTAC
TATGTGGGACCCCTGGCCCGAGGGAACTCTCGGTTCGCATGGATGACAAG
AAAGTCCGAAGAAACGATTACTCCATGGAATTTTGAGGAAGTTGTCGATA
AAGGTGCGTCAGCTCAATCGTTCATCGAGAGGATGACCAACTTTGACAAG
AATTTACCGAACGAAAAGTATTGCCTAAGCACAGTTTACTTTACGAGTA
TTTCACAGTGTACAATGAACTCACGAAAGTTAAGTATGTCACTGAGGGCA
TGCGTAAACCCGCCTTTCTAAGCGGAGAACAGAAGAAAGCAATAGTAGAT
CTGTTATTCAAGACCAACCGCAAAGTGACAGTTAAGCAATTGAAAGAGGA
CTACTTTAAGAAAATTGAATGCTTCGATTCTGTCGAGATCTCCGGGGTAG
AAGATCGATTTAATGCGTCACTTGGTACGTATCATGACCTCCTAAAGATA
ATTAAAGATAAGGACTTCCTGGATAACGAAGAGAATGAAGATATCTTAGA
AGATATAGTGTTGACTCTTACCCTCTTTGAAGATCGGGAAATGATTGAGG
AAAGACTAAAAACATACGCTCACCTGTTCGACGATAAGGTTATGAAACAG
TTAAAGAGGCGTCGCTATACGGGCTGGGGACGATTGTCGCGGAAACTTAT
CAACGGGATAAGAGACAAGCAAAGTGGTAAAACTATTCTCGATTTTCTAA
AGAGCGACGGCTTCGCCAATAGGAACTTTATGCAGCTGATCCATGATGAC
TCTTTAACCTTCAAAGAGGATATACAAAAGGCACAGGTTTCCGGACAAGG
GGACTCATTGCACGAACATATTGCGAATCTTGCTGGTTCGCCAGCCATCA
AAAAGGGCATACTCCAGACAGTCAAAGTAGTGGATGAGCTAGTTAAGGTC
ATGGGACGTCACAAACCGGAAAACATTGTAATCGAGATGGCACGCGAAAA
TCAAACGACTCAGAAGGGGCAAAAAACAGTCGAGAGCGGATGAAGAGAA
TAGAAGAGGGTATTAAAGAACTGGGCAGCCAGATCTTAAAGGAGCATCCT
GTGGAAAATACCCAATTGCAGAACGAGAAACTTTACCTCTATTACCTACA
AAATGAAGGGACATGTATGTTGATCAGGAACTGGACATAAACCGTTTAT
CTGATTACGACGTCGATCACATTGTACCCCAATCCTTTTTGAAGGACGAT
TCAATCGACAATAAAGTGCTTACACGCTCGGATAAGAACCGAGGGAAAAG
TGACAATGTTCCAAGCGAGGAAGTCGTAAAGAAAATGAAGAACTATTGGC
GGCAGCTCCTAAATGCGAAACTGATAACGCAAAGAAAGTTCGATAACTTA
ACTAAAGCTGAGAGGGGTGGCTTGTCTGAACTTGACAAGGCCGGATTTAT
TAAACGTCAGCTCGTGGAAACCCGCCAAATCACAAAGCATGTTGCACAGA
TACTAGATTCCCGAATGAATACGAAATACGACGAGAACGATAAGCTGATT
CGGGAAGTCAAAGTAATCACTTTAAAGTCAAAATTGGTGTCGGACTTCAG
AAAGGATTTTCAATTCTATAAAGTTAGGGAGATAAATAACTACCACCATG
CGCACGACGCTTATCTTAATGCCGTCGTAGGGACCGCACTCATTAAGAAA
TACCCGAAGCTAGAAAGTGAGTTTGTGTATGGTGATTACAAAGTTTATGA
CGTCCGTAAGATGATCGCGAAAAGCGAACAGGAGATAGGCAAGGCTACAG
CCAAATACTTCTTTTATTCTAACATTATGAATTTCTTTAAGACGGAAATC
ACTCTGGCAAACGGAGAGATACGCAAACGACCTTTAATTGAAACCAATGG
GGAGACAGGTGAAATCGTATGGGATAAGGGCCGGGACTTCGCGACGGTGA
GAAAAGTTTTGTCCATGCCCCAAGTCAACATAGTAAAGAAAACTGAGGTG
```

-continued

CAGACCGGAGGGTTTTCAAAGGAATCGATTCTTCCAAAAAGGAATAGTGA

TAAGCTCATCGCTCGTAAAAAGGACTGGGACCCGAAAAAGTACGGTGGCT

TCGATAGCCCTACAGTTGCCTATTCTGTCCTAGTAGTGGCAAAAGTTGAG

AAGGGAAAATCCAAGAAACTGAAGTCAGTCAAAGAATTATTGGGGATAAC

GATTATGGAGCGCTCGTCTTTTGAAAAGAACCCCATCGACTTCCTTGAGG

CGAAAGGTTACAAGGAAGTAAAAAAGGATCTCATAATTAAACTACCAAAG

TATAGTCTGTTTGAGTTAGAAAATGGCCGAAAACGGATGTTGGCTAGCGC

CGGAGAGCTTCAAAAGGGGAACGAACTCGCACTACCGTCTAAATACGTGA

ATTTCCTGTATTTAGCGTCCCATTACGAGAAGTTGAAAGGTTCACCTGAA

GATAACGAACAGAAGCAACTTTTTGTTGAGCAGCACAAACATTATCTCGA

CGAAATCATAGAGCAAATTTCGGAATTCAGTAAGAGAGTCATCCTAGCTG

ATGCCAATCTGGACAAAGTATTAAGCGCATACAACAAGCACAGGGATAAA

CCCATACGTGAGCAGGCGGAAAATATTATCCATTTGTTTACTCTTACCAA

CCTCGGCGCTCCAGCCGCATTCAAGTATTTTGACACAACGATAGATCGCA

AACGATACACTTCTACCAAGGAGGTGCTAGACGCGACACTGATTCACCAA

TCCATCACGGGATTATATGAAACTCGGATAGATTTGTCACAGCTTGGGGG

TGACGGATCCCCCAAGAAGAAGAGGAAAGTCTCGAGCGACTACAAAGACC

ATGACGGTGATTATAAAGATCATGACATCGATTACAAGGATGACGATGAC

AAGGCTGCAGGA (SEQ ID NO: 682)
MDKKYSIGLAIGTNSVGWAVITDEYKVPSKKFKVLGNTDRHSIKKNLIGA

LLFDSGETAEATRLKRTARRRYTRRKNRICYLQEIFSNEMAKVDDSFFHR

LEESFLVEEDKKHERHPIFGNIVDEVAYHEKYPTIYHLRKKLVDSTDKAD

LRLIYLALAHMIKFRGHFLIEGDLNPDNSDVDKLFIQLVQTYNQLFEENP

INASGVDAKAILSARLSKSRRLENLIAQLPGEKKNGLFGNLIALSLGLTP

NFKSNFDLAEDAKLQLSKDTYDDDLDNLLAQIGDQYADLFLAAKNLSDAI

LLSDILRVNTEITKAPLSASMIKRYDEHHQDLTLLKALVRQQLPEKYKEI

FFDQSKNGYAGYIDGGASQEEFYKFIKPILEKMDGTEELLVKLNREDLLR

KQRTFDNGSIPHQIHLGELHAILRRQEDFYPFLKDNREKIEKILTFRIPY

YVGPLARGNSRFAWMTRKSEETITPWNFEEVVDKGASAQSFIERMTNFDK

NLPNEKVLPKHSLLYEYFTVYNELTKVKYVTEGMRKPAFLSGEQKKAIVD

LLFKTNRKVTVKQLKEDYFKKIECFDSVEISGVEDRFNASLGTYHDLLKI

IKDKDFLDNEENEDILEDIVLTLTLFEDREMIEERLKTYAHLFDDKVMKQ

LKRRRYTGWGRLSRKLINGIRDKQSGKTILDFLKSDGFANRNFMQLIHDD

SLTFKEDIQKAQVSGQGDSLHEHIANLAGSPAIKKGILQTVKVVDELVKV

MGRHKPENIVIEMARENQTTQKGQKNSRERMKRIEEGIKELGSQILKEHP

VENTQLQNEKLYLYYLQNGRDMYVDQELDINRLSDYDVDHIVPQSFLKDD

SIDNKVLTRSDKNRGKSDNVPSEEVVKKMKNYWRQLLNAKLITQRKFDNL

TKAERGGLSELDKAGFIKRQLVETRQITKHVAQILDSRMNTKYDENDKLI

REVKVITLKSKLVSDFRKDFQFYKVREINNYHHAHDAYLNAVVGTALIKK

YPKLESEFVYGDYKVYDVRKMIAKSEQEIGKATAKYFFYSNIMNFFKTEI

-continued

TLANGEIRKRPLIETNGETGEIVWDKGRDFATVRKVLSMPQVNIVKKTEV

QTGGFSKESILPKRNSDKLIARKKDWDPKKYGGFDSPTVAYSVLVVAKVE

KGKSKKLKSVKELLGITIMERSSFEKNPIDFLEAKGYKEVKKDLIIKLPK

YSLFELENGRKRMLASAGELQKGNELALPSKYVNFLYLASHYEKLKGSPE

DNEQKQLFVEQHKHYLDEIIEQISEFSKRVILADANLDKVLSAYNKHRDK

PIREQAENIIHLFTLTNLGAPAAFKYFDTTIDRKRYTSTKEVLDATLIHQ

SITGLYETRIDLSQLGGD
(single underline: HNH domain;
double underline: RuvC domain)

In some embodiments, Cas9 refers to Cas9 from: *Corynebacterium ulcerans* (NCBI Refs: NC_015683.1, NC_017317.1); *Corynebacterium diphtheria* (NCBI Refs: NC_016782.1, NC_016786.1); *Spiroplasma syrphidicola* (NCBI Ref: NC_021284.1); *Prevotella intermedia* (NCBI Ref: NC_017861.1); *Spiroplasma taiwanense* (NCBI Ref: NC_021846.1); *Streptococcus iniae* (NCBI Ref: NC_021314.1); *Belliella baltica* (NCBI Ref: NC_018010.1); *Psychroflexus torquisl* (NCBI Ref: NC_018721.1); *Streptococcus thermophilus* (NCBI Ref: YP_820832.1), *Listeria innocua* (NCBI Ref: NP_472073.1), *Campylobacter jejuni* (NCBI Ref: YP_002344900.1) or *Neisseria. meningitidis* (NCBI Ref: YP_002342100.1) or to a Cas9 from any of the organisms listed in Example 1 (SEQ ID NOs: 1-260, 270-292 or 315-323).

In some embodiments, proteins comprising fragments of Cas9 are provided. For example, in some embodiments, a protein comprises one of two Cas9 domains: (1) the gRNA binding domain of Cas9; or (2) the DNA cleavage domain of Cas9. In some embodiments, proteins comprising Cas9 or fragments thereof are referred to as "Cas9 variants." A Cas9 variant shares homology to Cas9, or a fragment thereof. For example, a Cas9 variant is at least about 70% identical, at least about 80% identical, at least about 90% identical, at least about 95% identical, at least about 96% identical, at least about 97% identical, at least about 98% identical, at least about 99% identical, at least about 99.5% identical, or at least about 99.9% identical to wild type Cas9. In some embodiments, the Cas9 variant may have 1, 2, 3, 4, 5, 6, 7, 8, 9, 10, 11, 12, 13, 14, 15, 16, 17, 18, 19, 20, 21, 22, 21, 24, 25, 26, 27, 28, 29, 30, 31, 32, 33, 34, 35, 36, 37, 38, 39, 40, 41, 42, 43, 44, 45, 46, 47, 48, 49, 50 or more amino acid changes compared to wild type Cas9. In some embodiments, the Cas9 variant comprises a fragment of Cas9 (e.g., a gRNA binding domain or a DNA-cleavage domain), such that the fragment is at least about 70% identical, at least about 80% identical, at least about 90% identical, at least about 95% identical, at least about 96% identical, at least about 97% identical, at least about 98% identical, at least about 99% identical, at least about 99.5% identical, or at least about 99.9% identical to the corresponding fragment of wild type Cas9. In some embodiments, the fragment is at least 30%, at least 35%, at least 40%, at least 45%, at least 50%, at least 55%, at least 60%, at least 65%, at least 70%, at least 75%, at least 80%, at least 85%, at least 90%, at least 95% identical, at least 96%, at least 97%, at least 98%, at least 99%, or at least 99.5% of the amino acid length of a corresponding wild type Cas9.

In some embodiments, the fragment is at least 100 amino acids in length. In some embodiments, the fragment is at least 100, at least 150, at least 200, at least 250, at least 300, at least 350, at least 400, at least 450, at least 500, at least 550, at least 600, at least 650, at least 700, at least 750, at least 800, at least 850, at least 900, at least 950, at least 1000, at least 1050, at least 1100, at least 1150, at least 1200, at least 1250, or at least 1300 amino acids in length.

To be used as in the fusion protein of the present disclosure as the guide nucleotide sequence-programmable DNA binding protein domain, a Cas9 protein typically needs to be nuclease inactive. A nuclease-inactive Cas9 protein may interchangeably be referred to as a "dCas9" protein (for nuclease-"dead" Cas9). Methods for generating a Cas9 protein (or a fragment thereof) having an inactive DNA cleavage domain are known (See, e.g., Jinek et al., *Science*. 337:816-821(2012); Qi et al., (2013) *Cell*. 28; 152(5):1173-83, which is incorporated herein by reference). For example, the DNA cleavage domain of Cas9 is known to include two subdomains, the HNH nuclease subdomain and the RuvC1 subdomain. The HNH subdomain cleaves the strand complementary to the gRNA, whereas the RuvC1 subdomain cleaves the non-complementary strand. Mutations within these subdomains can silence the nuclease activity of Cas9. For example, the mutations D10A and H840A completely inactivate the nuclease activity of *S. pyogenes* Cas9 (Jinek et al., *Science*. 337:816-821(2012); Qi et al., *Cell*. 28; 152(5):1173-83 (2013)).

*S. pyogenes* dCas9 (D10A and H840A)

(SEQ ID NO: 2)
MDKK<u>YSIGLAIGTNSVGWAVITDEYKVPSKKFKVLGNTDRHSIKKNLIGA</u>

<u>LLFDSGET</u>AEATRLKRTARRRYTRRKNRICYLQEIFSNEMAKVDDSFFHR

LEESFLVEEDKKHERHPIFGNIVDEVAYHEKYPTIYHLRKKLVDSTDKAD

LRLIYLALAHMIKFRGHFLIEGDLNPDNSDVDKLFIQLVQTYNQLFEENP

INASGVDAKAILSARLSKSRRLENLIAQLPGEKKNGLFGNLIALSLGLTP

NFKSNFDLAEDAKLQLSKDTYDDDLDNLLAQIGDQYADLFLAAKNLSDAI

LLSDILRVNTEITKAPLSASMIKRYDEHHQDLTLLKALVRQQLPEKYKEI

FFDQSKNGYAGYIDGGASQLEFYKFIKPILEKMDGTEELLVKLNREDLLR

KQRTFDNGSIPHQIHLGELHAILRRQEDFYPFLKDNREKIEKILTFRIPY

YVGPLARGNSRFAWMTRKSEETITPWNFEEVVDKGASAQSFIERMTNFDK

NLPNEKVLPKHSLLYEYFTVYNELTKVKYVTEGMRKPAFLSGEQKKAIVD

LLFKTNRKVTVKQLKEDYFKKIECFDSVEISGVEDRFNASLGTYHDLLKI

IKDKDFLDNEENEDILEDIVLTLTLFEDREMIEERLKTYAHLFDDKVMKQ

LKRRRYTGWGRLSRKLINGIRDKQSGKTILDFLKSDGFANRNFMQLIHDD

SLTFKEDIQKAQVSGQG<u>DSLHEHIANLAGSPAIKKGILQTVKVVDELVKV</u>

<u>MGRHKPENIVIEMAR</u>ENQTTQKG<u>QKNSRERMKRIEEGIKELGSQILKEHP</u>

<u>VENTQLQNEKLYLYYLQNGRDMYVDQELDINRLSDYDVDAIVPQSFLKDD</u>

<u>SIDNKVLTRSDKNRGKSDNVPSEEVVKKMKNYWRQLLNAKLITQRKFDNL</u>

<u>TKAERGGLSELDKAGFIKRQLVETRQITKHVAQILDSRMNTKYDENDKLI</u>

<u>REVKVITLKSKLVSDFRKDFQFYKVREINNYHHAHDAYLNAVVGTALIKK</u>

<u>YPKLESEFVYGDYKVYDVRKMIAKSEQEIGKATAKYFFYSNIMNFFKTEI</u>

<u>TLANGEIRKRPLIETNGETGEIVWDKGRDFATVRKVLSMPQVNIVKKTEV</u>

<u>QTGGFSKESILPKRNSDKLIARKKDWDPKKYGGFDSPTVAYSVLVVAKVE</u>

KGKSKKLKSVKELLGITIMERSSFEKNPIDFLEAKGYKEVKKDLIIKLPK

YSLFELENGRKRMLASAGELQKGNELALPSKYVNFLYLASHYEKLKGSPE

DNEQKQLFVEQHKHYLDEIIEQISEFSKRVILADANLDKVLSAYNKHRDK

PIREQAENIIHLFTLTNLGAPAAFKYFDTTIDRKRYTSTKEVLDATLIHQ

SITGLYETRI (single underline: HNH domain; double
underline: RuvC domain).

The dCas9 of the present disclosure encompasses completely inactive Cas9 or partially inactive Cas9. For example, the dCas9 may have one of the two nuclease domain inactivated, while the other nuclease domain remains active. Such a partially active Cas9 may also be referred to as a Cas9 nickase, due to its ability to cleave one strand of the targeted DNA sequence. The Cas9 nickase suitable for use in accordance with the present disclosure has an active HNH domain and an inactive RuvC domain and is able to cleave only the strand of the target DNA that is bound by the sgRNA (which is the opposite strand of the strand that is being edited via deamination). The Cas9 nickase of the present disclosure may comprise mutations that inactivate the RuvC domain, e.g., a D10A mutation. It is to be understood that any mutation that inactivates the RuvC domain may be included in a Cas9 nickase, e.g., insertion, deletion, or single or multiple amino acid substitution in the RuvC domain. In a Cas9 nickase described herein, while the RuvC domain is inactivated, the HNH domain remains active. Thus, while the Cas9 nickase may comprise mutations other than those that inactivate the RuvC domain (e.g., D10A), those mutations do not affect the activity of the HNH domain. In a non-limiting Cas9 nickase example, the histidine at position 840 remains unchanged. The sequence of exemplary Cas9 nickases suitable for the present disclosure is provided below.

*S. pyogenes* Cas9 Nickase (D10A)

(SEQ ID NO: 3)
MDKK<u>YSIGLAIGTNSVGWAVITDEYKVPSKKFKVLGNTDRHSIKKNLIGA</u>

<u>LLFDSGET</u>AEATRLKRTARRRYTRRKNRICYLQEIFSNEMAKVDDSFFHR

LEESFLVEEDKKHERHPIFGNIVDEVAYHEKYPTIYHLRKKLVDSTDKAD

LRLIYLALAHMIKFRGHFLIEGDLNPDNSDVDKLFIQLVQTYNQLFEENP

INASGVDAKAILSARLSKSRRLENLIAQLPGEKKNGLFGNLIALSLGLTP

NFKSNFDLAEDAKLQLSKDTYDDDLDNLLAQIGDQYADLFLAAKNLSDAI

LLSDILRVNTEITKAPLSASMIKRYDEHHQDLTLLKALVRQQLPEKYKEI

FFDQSKNGYAGYIDGGASQEEFYKFIKPILEKMDGTEELLVKLNREDLLR

KQRTFDNGSIPHQIHLGELHAILRRQEDFYPFLKDNREKIEKILTFRIPY

YVGPLARGNSRFAWMTRKSEETITPWNFEEVVDKGASAQSFIERMTNFDK

NLPNEKVLPKHSLLYEYFTVYNELTKVKYVTEGMRKPAFLSGEQKKAIVD

LLFKTNRKVTVKQLKEDYFKKIECFDSVEISGVEDRFNASLGTYHDLLKI

IKDKDFLDNEENEDILEDIVLTLTLFEDREMIEERLKTYAHLFDDKVMKQ

LKRRRYTGWGRLSRKLINGIRDKQSGKTILDFLKSDGFANRNFMQLIHDD

SLTFKEDIQKAQVSGQG<u>DSLHEHIANLAGSPAIKKGILQTVKVVDELVKV</u>

<u>MGRHKPENIVIEMAR</u>ENQTTQKG<u>QKNSRERMKRIEEGIKELGSQILKEHP</u>

<u>VENTQLQNEKLYLYYLQNGRDMYVDQELDINRLSDYDVDHIVPQSFLKDD</u>

-continued
SIDNKVLTRSDKNRGKSDNVPSEEVVKKMKNYWRQLLNAKLITQRKFDNL

TKAERGGLSELDKAGFIKRQLVETRQITKHVAQILDSRMNTKYDENDKLI

REVKVITLKSKLVSDFRKDFQFYKVREINNYHHAHDAYLNAVVGTALIKK

YPKLESEFVYGDYKVYDVRKMIAKSEQEIGKATAKYFFYSNIMNFFKTEI

TLANGEIRKRPLIETNGETGEIVWDKGRDFATVRKVLSMPQVNIVKKTEV

QTGGFSKESILPKRNSDKLIARKKDWDPKKYGGFDSPTVAYSVLVVAKVE

KGKSKKLKSVKELLGITIMERSSFEKNPIDFLEAKGYKEVKKDLIIKLPK

YSLFELENGRKRMLASAGELQKGNELALPSKYVNFLYLASHYEKLKGSPE

DNEQKQLFVEQHKHYLDEIIEQISEFSKRVILADANLDKVLSAYNKHRDK

PIREQAENIIHLFTLTNLGAPAAFKYFDTTIDRKRYTSTKEVLDATLIHQ

SITGLYETRIDLSQLGGD
(single underline: HNH domain;
double underline: RuvC domain)

S. aureus Cas9 Nickase (D10A)
(SEQ ID NO: 6)
MKRNYILGLDIGITSVGYGIIDYETRDVIDAGVRLFKEANVENNEGRRSK

RGARRLKRRRRHRIQRVKKLLFDYNLLTDHSELSGINPYEARVKGLSQKL

SEEEFSAALLHLAKRRGVHNVNEVEEDTGNELSTKEQISRNSKALEEKYV

AELQLERLKKDGEVRGSINRFKTSDYVKEAKQLLKVQKAYHQLDQSFIDT

YIDLLETRRTYYEGPGEGSPFGWKDIKEWYEMLMGHCTYFPEELRSVKYA

YNADLYNALNDLNNLVITRDENEKLEYYEKFQIIENVFKQKKKPTLKQIA

KEILVNEEDIKGYRVTSTGKPEFTNLKVYHDIKDITARKEIIENAELLDQ

IAKILTIYQSSEDIQEELTNLNSELTQEEIEQISNLKGYTGTHNLSLKAI

NLILDELWHTNDNQIAIFNRLKLVPKKVDLSQQKEIPTTLVDDFILSPVV

KRSFIQSIKVINAIIKKYGLPNDIIIELAREKNSKDAQKMINEMQKRNRQ

TNERIEEIIRTTGKENAKYLIEKIKLHDMQEGKCLYSLEAIPLEDLLNNP

FNYEVDHIIPRSVSFDNSFNNKVLVKQEENSKKGNRTPFQYLSSSDSKIS

YETFKKHILNLAKGKGRISKTKKEYLLEERDINRFSVQKDFINRNLVDTR

YATRGLMNLLRSYFRVNNLDVKVKSINGGFTSFLRRKWKFKKERNKGYKH

HAEDALIIANADFIFKEWKKLDKAKKVMENQMFEEKQAESMPEIETEQEY

KEIFITPHQIKHIKDFKDYKYSHRVDKKPNRELINDTLYSTRKDDKGNTL

IVNNLNGLYDKDNDKLKKLINKSPEKLLMYHHDPQTYQKLKLIMEQYGDE

KNPLYKYYEETGNYLTKYSKKDNGPVIKKIKYYGNKLNAHLDITDDYPNS

RNKVVKLSLKPYRFDVYLDNGVYKFVTVKNLDVIKKENYYEVNSKCYEEA

KKLKKISNQAEFIASFYNNDLIKINGELYRVIGVNNDLLNRIEVNMIDIT

YREYLENMNDKRPPRIIKTIASKTQSIKKYSTDILGNLYEVKSKKHPQII

KKG

The targeting range of base editors was further expanded by applying recently engineered Cas9 variants that expand or alter PAM specificities. Joung and coworkers recently reported three SpCas9 mutants that accept NGA (VQR-Cas9), NGAG (EQR-Cas9), or NGCG (VRER-Cas9) PAM sequences (see: Kleinstiver, B. P. et al. Engineered CRISPR-Cas9 nucleases with altered PAM specificities. *Nature* 523, 481-485; 2015, which is herein incorporated by reference in its entirety). In addition, Joung and coworkers engineered a SaCas9 variant containing three mutations (SaKKH-Cas9) that relax its PAM requirement to NNNRRT (see: Kleinstiver, B. P. et al. Broadening the targeting range of *Staphylococcus aureus* CRISPR-Cas9 by modifying PAM recognition. *Nat. Biotechnol.* 33, 1293-1298; 2015, which is herein incorporated by reference in its entirety).

VRER-Cas9 (D1135V/G1218R/R1335E/T1337R) S.
pyogenes Cas9
(SEQ ID NO: 7)
MDKKYSIGLDIGTNSVGWAVITDEYKVPSKKFKVLGNTDRHSIKKNLIGA

LLFDSGETAEATRLKRTARRRYTRRKNRICYLQEIFSNEMAKVDDSFFHR

LEESFLVEEDKKHERHPIFGNIVDEVAYHEKYPTIYHLRKKLVDSTDKAD

LRLIYLALAHMIKFRGHFLIEGDLNPDNSDVDKLFIQLVQTYNQLFEENP

INASGVDAKAILSARLSKSRRLENLIAQLPGEKKNGLFGNLIALSLGLTP

NFKSNFDLAEDAKLQLSKDTYDDDLDNLLAQIGDQYADLFLAAKNLSDAI

LLSDILRVNTEITKAPLSASMIKRYDEHHQDLTLLKALVRQQLPEKYKEI

FFDQSKNGYAGYIDGGASQEEFYKFIKPILEKMDGTEELLVKLNREDLLR

KQRTFDNGSIPHQIHLGELHAILRRQEDFYPFLKDNREKIEKILTFRIPY

YVGPLARGNSRFAWMTRKSEETITPWNFEEVVDKGASAQSFIERMTNFDK

NLPNEKVLPKHSLLYEYFTVYNELTKVKYVTEGMRKPAFLSGEQKKAIVD

LLFKTNRKVTVKQLKEDYFKKIECFDSVEISGVEDRFNASLGTYHDLLKI

IKDKDFLDNEENEDILEDIVLTLTLFEDREMIEERLKTYAHLFDDKVMKQ

LKRRRYTGWGRLSRKLINGIRDKQSGKTILDFLKSDGFANRNFMQLIHDD

SLTFKEDIQKAQVSGQGDSLHEHIANLAGSPAIKKGILQTVKVVDELVKV

MGRHKPENIVIEMARENQTTQKGQKNSRERMKRIEEGIKELGSQILKEHP

VENTQLQNEKLYLYYLQNGRDMYVDQELDINRLSDYDVDHIVPQSFLKDD

SIDNKVLTRSDKNRGKSDNVPSEEVVKKMKNYWRQLLNAKLITQRKFDNL

TKAERGGLSELDKAGFIKRQLVETRQITKHVAQILDSRMNTKYDENDKLI

REVKVITLKSKLVSDFRKDFQFYKVREINNYHHAHDAYLNAVVGTALIKK

YPKLESEFVYGDYKVYDVRKMIAKSEQEIGKATAKYFFYSNIMNFFKTEI

TLANGEIRKRPLIETNGETGEIVWDKGRDFATVRKVLSMPQVNIVKKTEV

QTGGFSKESILPKRNSDKLIARKKDWDPKKYGGFVSPTVAYSVLVVAKVE

KGKSKKLKSVKELLGITIMERSSFEKNPIDFLEAKGYKEVKKDLIIKLPK

YSLFELENGRKRMLASARELQKGNELALPSKYVNFLYLASHYEKLKGSPE

DNEQKQLFVEQHKHYLDEIIEQISEFSKRVILADANLDKVLSAYNKHRDK

PIREQAENIIHLFTLTNLGAPAAFKYFDTTIDRKEYRSTKEVLDATLIHQ

SITGLYETRIDLSQLGGD
(single underline: HNH domain;
double underline: RuvC domain)

VRER-nCas9 (D10A/D1135V/G1218R/R1335E/T1337R) S.
pyogenes Cas9 Nickase
(SEQ ID NO: 8)
MDKKYSIGLAIGTNSVGWAVITDEYKVPSKKFKVLGNTDRHSIKKNLIGA

LLFDSGETAEATRLKRTARRRYTRRKNRICYLQEIFSNEMAKVDDSFFHR

LEESFLVEEDKKHERHPIFGNIVDEVAYHEKYPTIYHLRKKLVDSTDKAD

LRLIYLALAHMIKFRGHFLIEGDLNPDNSDVDKLFIQLVQTYNQLFEENP

INASGVDAKAILSARLSKSRRLENLIAQLPGEKKNGLFGNLIALSLGLTP

-continued

NFKSNFDLAEDAKLQLSKDTYDDDLDNLLAQIGDQYADLFLAAKNLSDAI
LLSDILRVNTEITKAPLSASMIKRYDEHHQDLTLLKALVRQQLPEKYKEI
FFDQSKNGYAGYIDGGASQLEFYKFIKPILEKMDGTEELLVKLNREDLLR
KQRTFDNGSIPHQIHLGELHAILRRQEDFYPFLKDNREKIEKILTFRIPY
YVGPLARGNSRFAWMTRKSEETITPWNFEEVVDKGASAQSFIERMTNFDK
NLPNEKVLPKHSLLYEYFTVYNELTKVKYVTEGMRKPAFLSGEQKKAIVD
LLFKTNRKVTVKQLKEDYFKKIECFDSVEISGVEDRFNASLGTYHDLLKI
IKDKDFLDNEENEDILEDIVLTLTLFEDREMIEERLKTYAHLFDDKVMKQ
LKRRRYTGWGRLSRKLINGIRDKQSGKTILDFLKSDGFANRNFMQLIHDD
SLTFKEDIQKAQVSGQG<u>DSLHEHIANLAGSPAIKKGILQTVKVVDELVKV</u>
<u>MGRHKPENIVIEMA</u>RENQTTQK<u>GQKNSRERMKRIEEGIKELGSQILKEHP</u>
<u>VENTQLQNEKLYLYYLQNGRDMYVDQELDINRLSDYDVDHIVPQSFLKDD</u>
<u>SIDNKVLTRSDKNRGKSDNVPSEEVVKKMKNYWRQLLNAKLITQRKFDNL</u>
<u>TKAERGG</u>LSELDKAGFIKRQLVETRQITKHVAQILDSRMNTKYDENDKLI
REVKVITLKSKLVSDFRKDFQFYKVREINNYHHAHDAYLNAVVGTALIKK
YPKLESEFVYGDYKVYDVRKMIAKSEQEIGKATAKYFFYSNIMNFFKTEI
TLANGEIRKRPLIETNGETGEIVWDKGRDFATVRKVLSMPQVNIVKKTEV
QTGGFSKESILPKRNSDKLIARKKDWDPKKYGGFVSPTVAYSVLVVAKVE
KGKSKKLKSVKELLGITIMERSSFEKNPIDFLEAKGYKEVKKDLIIKLPK
YSLFELENGRKRMLASARELQKGNELALPSKYVNFLYLASHYEKLKGSPE
DNEQKQLFVEQHKHYLDEIIEQISEFSKRVILADANLDKVLSAYNKHRDK
PIREQAENIIHLFTLTNLGAPAAFKYFDTTIDRKEYRSTKEVLDATLIHQ
SITGLYETRIDLSQLGGD
(single underline: HNH domain;
double underline: RuvC domain)

VQR-Cas9 (D1135V/R1335Q/T1337R) *S. pyogenes* Cas9
(SEQ ID NO: 9)
MDKK<u>YSIGLDIGTNSVGWAVITDEYKVPSKKFKVLGNTDRHSIKKNLIGA</u>
<u>LLFDSGET</u>AEATRLKRTARRRYTRRKNRICYLQEIFSNEMAKVDDSFFHR
LEESFLVEEDKKHERHPIFGNIVDEVAYHEKYPTIYHLRKKLVDSTDKAD
LRLIYLALAHMIKFRGHFLIEGDLNPDNSDVDKLFIQLVQTYNQLFEENP
INASGVDAKAILSARLSKSRRLENLIAQLPGEKKNGLFGNLIALSLGLTP
NFKSNFDLAEDAKLQLSKDTYDDDLDNLLAQIGDQYADLFLAAKNLSDAI
LLSDILRVNTEITKAPLSASMIKRYDEHHQDLTLLKALVRQQLPEKYKEI
FFDQSKNGYAGYIDGGASQLEFYKFIKPILEKMDGTEELLVKLNREDLLR
KQRTFDNGSIPHQIHLGELHAILRRQEDFYPFLKDNREKIEKILTFRIPY
YVGPLARGNSRFAWMTRKSEETITPWNFEEVVDKGASAQSFIERMTNFDK
NLPNEKVLPKHSLLYEYFTVYNELTKVKYVTEGMRKPAFLSGEQKKAIVD
LLFKTNRKVTVKQLKEDYFKKIECFDSVEISGVEDRFNASLGTYHDLLKI
IKDKDFLDNEENEDILEDIVLTLTLFEDREMIEERLKTYAHLFDDKVMKQ
LKRRRYTGWGRLSRKLINGIRDKQSGKTILDFLKSDGFANRNFMQLIHDD
SLTFKEDIQKAQVSGQG<u>DSLHEHIANLAGSPAIKKGILQTVKVVDELVKV</u>
<u>MGRHKPENIVIEMA</u>RENQTTQK<u>GQKNSRERMKRIEEGIKELGSQILKEHP</u>
<u>VENTQLQNEKLYLYYLQNGRDMYVDQELDINRLSDYDVDHIVPQSFLKDD</u>
<u>SIDNKVLTRSDKNRGKSDNVPSEEVVKKMKNYWRQLLNAKLITQRKFDNL</u>
<u>TKAERGG</u>LSELDKAGFIKRQLVETRQITKHVAQILDSRMNTKYDENDKLI
REVKVITLKSKLVSDFRKDFQFYKVREINNYHHAHDAYLNAVVGTALIKK
YPKLESEFVYGDYKVYDVRKMIAKSEQEIGKATAKYFFYSNIMNFFKTEI
TLANGEIRKRPLIETNGETGEIVWDKGRDFATVRKVLSMPQVNIVKKTEV
QTGGFSKESILPKRNSDKLIARKKDWDPKKYGGFVSPTVAYSVLVVAKVE
KGKSKKLKSVKELLGITIMERSSFEKNPIDFLEAKGYKEVKKDLIIKLPK
YSLFELENGRKRMLASAGELQKGNELALPSKYVNFLYLASHYEKLKGSPE
DNEQKQLFVEQHKHYLDEIIEQISEFSKRVILADANLDKVLSAYNKHRDK
PIREQAENIIHLFTLTNLGAPAAFKYFDTTIDRKQYRSTKEVLDATLIHQ
SITGLYETRIDLSQLGGD
(single underline: HNH domain;
double underline: RuvC domain)

VQR-nCas9 (D10A/D1135V/R1335Q/T1337R) *S. pyogenes*
Cas9 Nickase
(SEQ ID NO: 315)
MDKK<u>YSIGLAIGTNSVGWAVITDEYKVPSKKFKVLGNTDRHSIKKNLIGA</u>
<u>LLFDSGETAEATRLKRTARRRYTRRKNRICYLQEIFSNEMAKVDDSFFHR</u>
LEESFLVEEDKKHERHPIFGNIVDEVAYHEKYPTIYHLRKKLVDSTDKAD
LRLIYLALAHMIKFRGHFLIEGDLNPDNSDVDKLFIQLVQTYNQLFEENP
INASGVDAKAILSARLSKSRRLENLIAQLPGEKKNGLFGNLIALSLGLTP
NFKSNFDLAEDAKLQLSKDTYDDDLDNLLAQIGDQYADLFLAAKNLSDAI
LLSDILRVNTEITKAPLSASMIKRYDEHHQDLTLLKALVRQQLPEKYKEI
FFDQSKNGYAGYIDGGASQLEFYKFIKPILEKMDGTEELLVKLNREDLLR
KQRTFDNGSIPHQIHLGELHAILRRQEDFYPFLKDNREKIEKILTFRIPY
YVGPLARGNSRFAWMTRKSEETITPWNFEEVVDKGASAQSFIERMTNFDK
NLPNEKVLPKHSLLYEYFTVYNELTKVKYVTEGMRKPAFLSGEQKKAIVD
LLFKTNRKVTVKQLKEDYFKKIECFDSVEISGVEDRFNASLGTYHDLLKI
IKDKDFLDNEENEDILEDIVLTLTLFEDREMIEERLKTYAHLFDDKVMKQ
LKRRRYTGWGRLSRKLINGIRDKQSGKTILDFLKSDGFANRNFMQLIHDD
SLTFKEDIQKAQVSGQG<u>DSLHEHIANLAGSPAIKKGILQTVKVVDELVKV</u>
<u>MGRHKPENIVIEMA</u>RENQTTQK<u>GQKNSRERMKRIEEGIKELGSQILKEHP</u>
<u>VENTQLQNEKLYLYYLQNGRDMYVDQELDINRLSDYDVDHIVPQSFLKDD</u>
<u>SIDNKVLTRSDKNRGKSDNVPSEEVVKKMKNYWRQLLNAKLITQRKFDNL</u>
<u>TKAERGG</u>LSELDKAGFIKRQLVETRQITKHVAQILDSRMNTKYDENDKLI
REVKVITLKSKLVSDFRKDFQFYKVREINNYHHAHDAYLNAVVGTALIKK
YPKLESEFVYGDYKVYDVRKMIAKSEQEIGKATAKYFFYSNIMNFFKTEI
TLANGEIRKRPLIETNGETGEIVWDKGRDFATVRKVLSMPQVNIVKKTEV
QTGGFSKESILPKRNSDKLIARKKDWDPKKYGGFVSPTVAYSVLVVAKVE
KGKSKKLKSVKELLGITIMERSSFEKNPIDFLEAKGYKEVKKDLIIKLPK -continued
YSLFELENGRKRMLASAGELQKGNELALPSKYVNFLYLASHYEKLKGSPE
DNEQKQLFVEQHKHYLDEIIEQISEFSKRVILADANLDKVLSAYNKHRDK
PIREQAENIIHLFTLTNLGAPAAFKYFDTTIDRKQYRSTKEVLDATLIHQ
SITGLYETRIDLSQLGGD
(single underline: HNH domain;
double underline: RuvC domain)

EQR-Cas9 (D1135E/R1335Q/T1337R) S. pyogenes Cas9
(SEQ ID NO: 316)
MDKKYSIGLDIGTNSVGWAVITDEYKVPSKKFKVLGNTDRHSIKKNLIGA
LLFDSGETAEATRLKRTARRRYTRRKNRICYLQEIFSNEMAKVDDSFFHR
LEESFLVEEDKKHERHPIFGNIVDEVAYHEKYPTIYHLRKKLVDSTDKAD
LRLIYLALAHMIKFRGHFLIEGDLNPDNSDVDKLFIQLVQTYNQLFEENP
INASGVDAKAILSARLSKSRRLENLIAQLPGEKKNGLFGNLIALSLGLTP
NFKSNFDLAEDAKLQLSKDTYDDDLDNLLAQIGDQYADLFLAAKNLSDAI
LLSDILRVNTEITKAPLSASMIKRYDEHHQDLTLLKALVRQQLPEKYKEI
FFDQSKNGYAGYIDGGASQEEFYKFIKPILEKMDGTEELLVKLNREDLLR
KQRTFDNGSIPHQIHLGELHAILRRQEDFYPFLKDNREKIEKILTFRIPY
YVGPLARGNSRFAWMTRKSEETITPWNFEEVVDKGASAQSFIERMTNFDK
NLPNEKVLPKHSLLYEYFTVYNELTKVKYVTEGMRKPAFLSGEQKKAIVD
LLFKTNRKVTVKQLKEDYFKKIECFDSVEISGVEDRFNASLGTYHDLLKI
IKDKDFLDNEENEDILEDIVLTLTLFEDREMIEERLKTYAHLFDDKVMKQ
LKRRRYTGWGRLSRKLINGIRDKQSGKTILDFLKSDGFANRNFMQLIHDD
SLTFKEDIQKAQVSGQGDSLHEHIANLAGSPAIKKGILQTVKVVDELVKV
MGRHKPENIVIEMARENQTTQKGQKNSRERMKRIEEGIKELGSQILKEHP
VENTQLQNEKLYLYYLQNGRDMYVDQELDINRLSDYDVDHIVPQSFLKDD
SIDNKVLTRSDKNRGKSDNVPSEEVVKKMKNYWRQLLNAKLITQRKFDNL
TKAERGGLSELDKAGFIKRQLVETRQITKHVAQILDSRMNTKYDENDKLI
REVKVITLKSKLVSDFRKDFQFYKVREINNYHHAHDAYLNAVVGTALIKK
YPKLESEFVYGDYKVYDVRKMIAKSEQEIGKATAKYFFYSNIMNFFKTEI
TLANGEIRKRPLIETNGETGEIVWDKGRDFATVRKVLSMPQVNIVKKTEV
QTGGFSKESILPKRNSDKLIARKKDWDPKKYGGFESPTVAYSVLVVAKVE
KGKSKKLKSVKELLGITIMERSSFEKNPIDFLEAKGYKEVKKDLIIKLPK
YSLFELENGRKRMLASAGELQKGNELALPSKYVNFLYLASHYEKLKGSPE
DNEQKQLFVEQHKHYLDEIIEQISEFSKRVILADANLDKVLSAYNKHRDK
PIREQAENIIHLFTLTNLGAPAAFKYFDTTIDRKQYRSTKEVLDATLIHQ
SITGLYETRIDLSQLGGD
(single underline: HNH domain;
double underline: RuvC domain)

EQR-nCas9 (D10A/D1135E/R1335Q/T1337R) S. pyogenes
Cas9 Nickase
(SEQ ID NO: 317)
MDKKYSIGLAIGTNSVGWAVITDEYKVPSKKFKVLGNTDRHSIKKNLIGA
LLFDSGETAEATRLKRTARRRYTRRKNRICYLQEIFSNEMAKVDDSFFHR
LEESFLVEEDKKHERHPIFGNIVDEVAYHEKYPTIYHLRKKLVDSTDKAD
LRLIYLALAHMIKFRGHFLIEGDLNPDNSDVDKLFIQLVQTYNQLFEENP
INASGVDAKAILSARLSKSRRLENLIAQLPGEKKNGLFGNLIALSLGLTP
NFKSNFDLAEDAKLQLSKDTYDDDLDNLLAQIGDQYADLFLAAKNLSDAI
LLSDILRVNTEITKAPLSASMIKRYDEHHQDLTLLKALVRQQLPEKYKEI
FFDQSKNGYAGYIDGGASQEEFYKFIKPILEKMDGTEELLVKLNREDLLR
KQRTFDNGSIPHQIHLGELHAILRRQEDFYPFLKDNREKIEKILTFRIPY
YVGPLARGNSRFAWMTRKSEETITPWNFEEVVDKGASAQSFIERMTNFDK
NLPNEKVLPKHSLLYEYFTVYNELTKVKYVTEGMRKPAFLSGEQKKAIVD
LLFKTNRKVTVKQLKEDYFKKIECFDSVEISGVEDRFNASLGTYHDLLKI
IKDKDFLDNEENEDILEDIVLTLTLFEDREMIEERLKTYAHLFDDKVMKQ
LKRRRYTGWGRLSRKLINGIRDKQSGKTILDFLKSDGFANRNFMQLIHDD
SLTFKEDIQKAQVSGQGDSLHEHIANLAGSPAIKKGILQTVKVVDELVKV
MGRHKPENIVIEMARENQTTQKGQKNSRERMKRIEEGIKELGSQILKEHP
VENTQLQNEKLYLYYLQNGRDMYVDQELDINRLSDYDVDHIVPQSFLKDD
SIDNKVLTRSDKNRGKSDNVPSEEVVKKMKNYWRQLLNAKLITQRKFDNL
TKAERGGLSELDKAGFIKRQLVETRQITKHVAQILDSRMNTKYDENDKLI
REVKVITLKSKLVSDFRKDFQFYKVREINNYHHAHDAYLNAVVGTALIKK
YPKLESEFVYGDYKVYDVRKMIAKSEQEIGKATAKYFFYSNIMNFFKTEI
TLANGEIRKRPLIETNGETGEIVWDKGRDFATVRKVLSMPQVNIVKKTEV
QTGGFSKESILPKRNSDKLIARKKDWDPKKYGGFESPTVAYSVLVVAKVE
KGKSKKLKSVKELLGITIMERSSFEKNPIDFLEAKGYKEVKKDLIIKLPK
YSLFELENGRKRMLASAGELQKGNELALPSKYVNFLYLASHYEKLKGSPE
DNEQKQLFVEQHKHYLDEIIEQISEFSKRVILADANLDKVLSAYNKHRDK
PIREQAENIIHLFTLTNLGAPAAFKYFDTTIDRKQYRSTKEVLDATLIHQ
SITGLYETRIDLSQLGGD
(single underline: HNH domain;
double underline: RuvC domain)

Further variants of Cas9 from *S. aureus* and *S. thermophilius* may also be used in the contemplated methods and compositions described herein.

KKH variant (E782K/N968K/R1015H) S. aureus Cas9
(SEQ ID NO: 318)
MKRNYILGLDIGITSGYGIIDYETRDVIDAGVRLFKEANVENNEGRRSKR
GARRLKRRRHRIQRVKKLLFDYNLLTDHSELSGINPYEARVKGLSQKLS
EEEFSAALLHLAKRRGVHNVNEVEEDTGNELSTKEQISRNSKALEEKYVA
ELQLERLKKDGEVRGSINRFKTSDYVKEAKQLLKVQKAYHQLDQSFIDTY
IDLLETRRTYYEGPGEGSPFGWKDIKEWYEMLMGHCTYFPEELRSVKYAY
NADLYNALNDLNNLVITRDENEKLEYYEKFQIIENVFKQKKKPTLKQIAK
EILVNEEDIKGYRVTSTGKPEFTNLKVYHDIKDITARKEIIENAELLDQI
AKILTIYQSSEDIQEELTNLNSELTQEEIEQISNLKGYTGTHNLSLKAIN
LILDELWHTNDNQIAIFNRLKLVPKKVDLSQQKEIPTTLVDDFILSPVVK
RSFIQSIKVINAIIKKYGLPNDIIIELAREKNSKDAQKMINEMQKRNRQT
NERIEEIIRTTGKENAKYLIEKIKLHDMQEGKCLYSLEAIPLEDLLNNPF
NYEVDHIIPRSVSFDNSFNNKVLVKQEENSKKGNRTPFQYLSSSDSKISY

ETFKKHILNLAKGKGRISKTKKEYLLEERDINRFSVQKDFINRNLVDTRY

ATRGLMNLLRSYFRVNNLDVKVKSINGGFTSFLRRKWKFKKERNKGYKHH

AEDALIIANADFIFKEWKKLDKAKKVMENQMFEEKQAESMPEIETEQEYK

EIFITPHQIKHIKDFKDYKYSHRVDKKPNRKLINDTLYSTRKDDKGNTLI

VNNLNGLYDKDNDKLKKLINKSPEKLLMYHHDPQTYQKLKLIMEQYGDEK

NPLYKYYEETGNYLTKYSKKDNGPVIKKIKYYGNKLNAHLDITDDYPNSR

NKVVKLSLKPYRFDVYLDNGVYKFVTVKNLDVIKKENYYEVNSKCYEEAK

KLKKISNQAEFIASFYKNDLIKINGELYRVIGVNNDLLNRIEVNMIDITY

REYLENMNDKRPPHIIKTIASKTQSIKKYSTDILGNLYEVKSKKHPQIIK

KG

KKH variant (D10A/E782K/N968K/R1015H) *S. aureus*
Cas9 Nickase (SEQ ID NO: 319)

MKRNYILGLAIGITSVGYGIIDYETRDVIDAGVRLFKEANVENNEGRRSK

RGARRLKRRRRHRIQRVKKLLFDYNLLTDHSELSGINPYEARVKGLSQKL

SEEEFSAALLHLAKRRGVHNVNEVEEDTGNELSTKEQISRNSKALEEKYV

AELQLERLKKDGEVRGSINRFKTSDYVKEAKQLLKVQKAYHQLDQSFIDT

YIDLLETRRTYYEGPGEGSPFGWKDIKEWYEMLMGHCTYFPEELRSVKYA

YNADLYNALNDLNNLVITRDENEKLEYYEKFQIIENVFKQKKKPTLKQIA

KEILVNEEDIKGYRVTSTGKPEFTNLKVYHDIKDITARKEIIENAELLDQ

IAKILTIYQSSEDIQEELTNLNSELTQEEIEQISNLKGYTGTHNLSLKAI

NLILDELWHTNDNQIAIFNRLKLVPKKVDLSQQKEIPTTLVDDFILSPVV

KRSFIQSIKVINAIIKKYGLPNDIIIELAREKNSKDAQKMINEMQKRNRQ

TNERIEEIIRTTGKENAKYLIEKIKLHDMQEGKCLYSLEAIPLEDLLNNP

FNYEVDHIIPRSVSFDNSFNNKVLVKQEENSKKGNRTPFQYLSSSDSKIS

YETFKKHILNLAKGKGRISKTKKEYLLEERDINRFSVQKDFINRNLVDTR

YATRGLMNLLRSYFRVNNLDVKVKSINGGFTSFLRRKWKFKKERNKGYKH

HAEDALIIANADFIFKEWKKLDKAKKVMENQMFEEKQAESMPEIETEQEY

KEIFITPHQIKHIKDFKDYKYSHRVDKKPNRKLINDTLYSTRKDDKGNTL

IVNNLNGLYDKDNDKLKKLINKSPEKLLMYHHDPQTYQKLKLIMEQYGDE

KNPLYKYYEETGNYLTKYSKKDNGPVIKKIKYYGNKLNAHLDITDDYPNS

RNKVVKLSLKPYRFDVYLDNGVYKFVTVKNLDVIKKENYYEVNSKCYEEA

KKLKKISNQAEFIASFYKNDLIKINGELYRVIGVNNDLLNRIEVNMIDIT

YREYLENMNDKRPPHIIKTIASKTQSIKKYSTDILGNLYEVKSKKHPQII

KKG

*Streptococcus thermophilus* CRISPR1 Cas9 (St1Cas9)

(SEQ ID NO: 320)

MSDLVLGLDIGIGSVGVGILNKVTGEIIHKNSRIFPAAQAENNLVRRTNR

QGRRLTRRKKHRRVRLNRLFEESGLITDFTKISINLNPYQLRVKGLTDEL

SNEELFIALKNMVKHRGISYLDDASDDGNSSIGDYAQIVKENSKQLETKT

PGQIQLERYQTYGQLRGDFTVEKDGKKHRLINVFPTSAYRSEALRILQTQ

QEFNPQITDEFINRYLEILTGKRKYYHGPGNEKSRTDYGRYRTSGETLDN

IFGILIGKCTFYPDEFRAAKASYTAQEFNLLNDLNNLTVPTETKKLSKEQ

KNQIINYVKNEKAMGPAKLFKYIAKLLSCDVADIKGYRIDKSGKAEIHTF

EAYRKMKTLETLDIEQMDRETLDKLAYVLTLNTEREGIQEALEHEFADGS

FSQKQVDELVQFRKANSSIFGKGWHNFSVKLMMELIPELYETSEEQMTIL

TRLGKQKTTSSSNKTKYIDEKLLTEEIYNPVVAKSVRQAIKIVNAAIKEY

GDFDNIVIEMARETNEDDEKKAIQKIQKANKDEKDAAMLKAANQYNGKAE

LPHSVFHGHKQLATKIRLWHQQGERCLYTGKTISIHDLINNSNQFEVDHI

LPLSITFDDSLANKVLVYATANQEKGQRTPYQALDSMDDAWSFRELKAFV

RESKTLSNKKKEYLLTEEDISKFDVRKKFIERNLVDTRYASRVVLNALQE

HFRAHKIDTKVSVVRGQFTSQLRRHWGIEKTRDTYHHHAVDALIIAASSQ

LNLWKKQKNTLVSYSEDQLLDIETGELISDDEYKESVFKAPYQHFVDTLK

SKEFEDSILFSYQVDSKFNRKISDATIYATRQAKVGKDKADETYVLGKIK

DIYTQDGYDAFMKIYKKDKSKFLMYRHDPQTFEKVIEPILENYPNKQINE

KGKEVPCNPFLKYKEEHGYIRKYSKKGNGPEIKSLKYYDSKLGNHIDITP

KDSNNKVVLQSVSPWRADVYFNKTTGKYEILGLKYADLQFEKGTGTYKIS

QEKYNDIKKKEGVDSDSEFKFTLYKNDLLLVKDTETKEQQLFRFLSRTMP

KQKHYVELKPYDKQKFEGGEALIKVLGNVANSGQCKKGLGKSNISIYKVR

TDVLGNQHIIKNEGDKPKLDF

*Streptococcus thermophilus* CRISPR1 Cas9 (St1Cas9)
Nickase (D9A)

(SEQ ID NO: 321)

MSDLVLGLAIGIGSVGVGILNKVTGEIIHKNSRIFPAAQAENNLVRRTNR

QGRRLTRRKKHRRVRLNRLFEESGLITDFTKISINLNPYQLRVKGLTDEL

SNEELFIALKNMVKHRGISYLDDASDDGNSSIGDYAQIVKENSKQLETKT

PGQIQLERYQTYGQLRGDFTVEKDGKKHRLINVFPTSAYRSEALRILQTQ

QEFNPQITDEFINRYLEILTGKRKYYHGPGNEKSRTDYGRYRTSGETLDN

IFGILIGKCTFYPDEFRAAKASYTAQEFNLLNDLNNLTVPTETKKLSKEQ

KNQIINYVKNEKAMGPAKLFKYIAKLLSCDVADIKGYRIDKSGKAEIHTF

EAYRKMKTLETLDIEQMDRETLDKLAYVLTLNTEREGIQEALEHEFADGS

FSQKQVDELVQFRKANSSIFGKGWHNFSVKLMMELIPELYETSEEQMTIL

TRLGKQKTTSSSNKTKYIDEKLLTEEIYNPVVAKSVRQAIKIVNAAIKEY

GDFDNIVIEMARETNEDDEKKAIQKIQKANKDEKDAAMLKAANQYNGKAE

LPHSVFHGHKQLATKIRLWHQQGERCLYTGKTISIHDLINNSNQFEVDHI

LPLSITFDDSLANKVLVYATANQEKGQRTPYQALDSMDDAWSFRELKAFV

RESKTLSNKKKEYLLTEEDISKFDVRKKFIERNLVDTRYASRVVLNALQE

HFRAHKIDTKVSVVRGQFTSQLRRHWGIEKTRDTYHHHAVDALIIAASSQ

LNLWKKQKNTLVSYSEDQLLDIETGELISDDEYKESVFKAPYQHFVDTLK

SKEFEDSILFSYQVDSKFNRKISDATIYATRQAKVGKDKADETYVLGKIK

DIYTQDGYDAFMKIYKKDKSKFLMYRHDPQTFEKVIEPILENYPNKQINE

KGKEVPCNPFLKYKEEHGYIRKYSKKGNGPEIKSLKYYDSKLGNHIDITP

KDSNNKVVLQSVSPWRADVYFNKTTGKYEILGLKYADLQFEKGTGTYKIS

QEKYNDIKKKEGVDSDSEFKFTLYKNDLLLVKDTETKEQQLFRFLSRTMP

KQKHYVELKPYDKQKFEGGEALIKVLGNVANSGQCKKGLGKSNISIYKVR

TDVLGNQHIIKNEGDKPKLDF

Streptococcus thermophilus CRISPR3Cas9 (St3Cas9)
(SEQ ID NO: 322)
MTKPYSIGLDIGTNSVGWAVITDNYKVPSKKMKVLGNTSKKYIKKNLLGV

LLFDSGITAEGRRLKRTARRRYTRRRNRILYLQEIFSTEMATLDDAFFQR

LDDSFLVPDDKRDSKYPIFGNLVEEKVYHDEFPTIYHLRKYLADSTKKAD

LRLVYLALAHMIKYRGHFLIEGEFNSKNNDIQKNFQDFLDTYNAIFESDL

SLENSKQLEEIVKDKISKLEKKDRILKLFPGEKNSGIFSEFLKLIVGNQA

DFRKCFNLDEKASLHFSKESYDEDLETLLGYIGDDYSDVFLKAKKLYDAI

LLSGFLTVTDNETEAPLSSAMIKRYNEHKEDLALLKEYIRNISLKTYNEV

FKDDTKNGYAGYIDGKTNQEDFYVYLKNLLAEFEGADYFLEKIDREDFLR

KQRTFDNGSIPYQIHLQEMRAILDKQAKFYPFLAKNKERIEKILTFRIPY

YVGPLARGNSDFAWSIRKRNEKITPWNFEDVIDKESSAEAFINRMTSFDL

YLPEEKVLPKHSLLYETFNVYNELTKVRFIAESMRDYQFLDSKQKKDIVR

LYFKDKRKVTDKDIIEYLHAIYGYDGIELKGIEKQFNSSLSTYHDLLNII

NDKEFLDDSSNEAIIEEIIHTLTIFEDREMIKQRLSKFENIFDKSVLKKL

SRRHYTGWGKLSAKLINGIRDEKSGNTILDYLIDDGISNRNFMQLIHDDA

LSFKKKIQKAQIIGDEDKGNIKEVVKSLPGSPAIKKGILQSIKIVDELVK

VMGGRKPESIVVEMARENQYTNQGKSNSQQRLKRLEKSLKELGSKILKEN

IPAKLSKIDNNALQNDRLYLYYLQNGKDMYTGDDLDIDRLSNYDIDHIIP

QAFLKDNSIDNKVLVSSASNRGKSDDFPSLEVVKKRKTFWYQLLKSKLIS

QRKFDNLTKAERGGLLPEDKAGFIQRQLVETRQITKHVARLLDEKFNNKK

DENNRAVRTVKIITLKSTLVSQFRKDFELYKVREINDFHHAHDAYLNAVI

ASALLKKYPKLEPEFVYGDYPKYNSFRERKSATEKVYFYSNIMNIFKKSI

SLADGRVIERPLIEVNEETGESVWNKESDLATVRRVLSYPQVNVVKKVEE

QNHGLDRGKPKGLFNANLSSKPKPNSNENLVGAKEYLDPKKYGGYAGISN

SFAVLVKGTIEKGAKKKITNVLEFQGISILDRINYRKDKLNFLLEKGYKD

IELIIELPKYSLFELSDGSRRMLASILSTNNKRGEIHKGNQIFLSQKFVK

LLYHAKRISNTINENHRKYVENHKKEFEELFYYILEFNENYVGAKKNGKL

LNSAFQSWQNHSIDELCSSFIGPTGSERKGLFELTSRGSAADFEFLGVKI

PRYRDYTPSSLLKDATLIHQSVTGLYETRIDLAKLGEG

Streptococcus thermophilus CRISPR3Cas9 (St3Cas9)
Nickase (D10A)
(SEQ ID NO: 323)
MTKPYSIGLAIGTNSVGWAVITDNYKVPSKKMKVLGNTSKKYIKKNLLGV

LLFDSGITAEGRRLKRTARRRYTRRRNRILYLQEIFSTEMATLDDAFFQR

LDDSFLVPDDKRDSKYPIFGNLVEEKVYHDEFPTIYHLRKYLADSTKKAD

LRLVYLALAHMIKYRGHFLIEGEFNSKNNDIQKNFQDFLDTYNAIFESDL

SLENSKQLEEIVKDKISKLEKKDRILKLFPGEKNSGIFSEFLKLIVGNQA

DFRKCFNLDEKASLHFSKESYDEDLETLLGYIGDDYSDVFLKAKKLYDAI

LLSGFLTVTDNETEAPLSSAMIKRYNEHKEDLALLKEYIRNISLKTYNEV

FKDDTKNGYAGYIDGKTNQEDFYVYLKNLLAEFEGADYFLEKIDREDFLR

KQRTFDNGS1PYQIHLQEMRAILDKQAKFYPFLAKNKERIEKILTFRIPY

YVGPLARGNSDFAWSIRKRNEKITPWNFEDVIDKESSAEAFINRMTSFDL

YLPEEKVLPKHSLLYETFNVYNELTKVRFIAESMRDYQFLDSKQKKDIVR

LYFKDKRKVTDKDIIEYLHAIYGYDGIELKGIEKQFNSSLSTYHDLLNII

NDKEFLDDSSNEAIIEEIIHTLTIFEDREMIKQRLSKFENIFDKSVLKKL

SRRHYTGWGKLSAKLINGIRDEKSGNTILDYLIDDGISNRNFMQLIHDDA

LSFKKKIQKAQIIGDEDKGNIKEVVKSLPGSPAIKKGILQSIKIVDELVK

VMGGRKPESIVVEMARENQYTNQGKSNSQQRLKRLEKSLKELGSKILKEN

IPAKLSKIDNNALQNDRLYLYYLQNGKDMYTGDDLDIDRLSNYDIDHIIP

QAFLKDNSIDNKVLVSSASNRGKSDDFPSLEVVKKRKTFWYQLLKSKLIS

QRKFDNLTKAERGGLLPEDKAGFIQRQLVETRQITKHVARLLDEKFNNKK

DENNRAVRTVKIITLKSTLVSQFRKDFELYKVREINDFHHAHDAYLNAVI

ASALLKKYPKLEPEFVYGDYPKYNSFRERKSATEKVYFYSNIMNIFKKSI

SLADGRVIERPLIEVNEETGESVWNKESDLATVRRVLSYPQVNVVKKVEE

QNHGLDRGKPKGLFNANLSSKPKPNSNENLVGAKEYLDPKKYGGYAGISN

SFAVLVKGTIEKGAKKKITNVLEFQGISILDRINYRKDKLNFLLEKGYKD

IELIIELPKYSLFELSDGSRRMLASILSTNNKRGEIHKGNQIFLSQKFVK

LLYHAKRISNTINENHRKYVENHKKEFEELFYYILEFNENYVGAKKNGKL

LNSAFQSWQNHSIDELCSSFIGPTGSERKGLFELTSRGSAADFEFLGVKI

PRYRDYTPSSLLKDATLIHQSVTGLYETRIDLAKLGEG

It is appreciated that when the term "dCas9" or "nuclease-inactive Cas9" is used herein, it refers to Cas9 variants that are inactive in both HNH and RuvC domains as well as Cas9 nickases. For example, the dCas9 used in the present disclosure may include the amino acid sequence set forth in SEQ ID NO: 2 or SEQ ID NO: 3. In some embodiments, the dCas9 may comprise other mutations that inactivate RuvC or HNH domain. Additional suitable mutations that inactivate Cas9 will be apparent to those of skill in the art based on this disclosure and knowledge in the field, and are within the scope of this disclosure. Such additional exemplary suitable nuclease-inactive Cas9 domains include, but are not limited to, D839A and/or N863A (See, e.g., Prashant et al., *Nature Biotechnology.* 2013; 31(9): 833-838, the entire contents of which are incorporated herein by reference), or K603R (See, e.g., Chavez et al., *Nature Methods* 12, 326-328, 2015, the entire contents of which is incorporated herein by reference). The term Cas9, dCas9, or Cas9 variant also encompasses Cas9, dCas9, or Cas9 variants from any organism. Also appreciated is that dCas9, Cas9 nickase, or other appropriate Cas9 variants from any organisms may be used in accordance with the present disclosure. In one example, the Cas9 variants used herein are the D10A variants of Cas9 from *S. pyogenes* or *S. aureus*.

A "deaminase" refers to an enzyme that catalyzes the removal of an amine group from a molecule, or deamination. In some embodiments, the deaminase is a cytidine deaminase, catalyzing the deamination of cytidine or deoxycytidine to uridine or deoxyuridine, respectively. In some embodiments, the deaminase is a cytosine deaminase, catalyzing the hydrolytic deamination of cytosine to uracil (e.g., in RNA) or thymine (e.g., in DNA). In some embodiments, the deaminase is a naturally-occurring deaminase from an organism, such as a human, chimpanzee, gorilla, monkey, cow, dog, rat, or mouse. In some embodiments, the deaminase is a variant of a naturally-occurring deaminase from an organism, and the variant does not occur in nature. For example, in some embodiments, the deaminase or deaminase domain is at least 50%, at least 55%, at least 60%, at least 65%, at least 70%, at least 75%, at least 80%, at least 85%, at least 90%, at least 95%, at least 96%, at least 97%, at least 98%, at least 99%, or at least 99.5% identical to a naturally-occurring deaminase from an organism.

A "cytosine deaminase" refers to an enzyme that catalyzes the chemical reaction "cytosine+$H_2O$ ⇌ uracil+$NH_3$." As it may be apparent from the reaction formula, such chemical reactions result in a C to U/T nucleobase change. In the context of a gene, such nucleotide change, or mutation, may in turn lead to an amino acid change in the protein, which may affect the protein's function, e.g., loss-of-function or gain-of-function.

One exemplary suitable class of cytosine deaminases is the apolipoprotein B mRNA-editing complex (APOBEC) family of cytosine deaminases encompassing eleven proteins that serve to initiate mutagenesis in a controlled and beneficial manner. The apolipoprotein B editing complex 3 (APOBEC3) enzyme provides protection to human cells against a certain HIV-1 strain via the deamination of cytosines in reverse-transcribed viral ssDNA. These cytosine deaminases all require a $Zn^{2+}$-coordinating motif (His-X-Glu-$X_{23-26}$-Pro-Cys-$X_{2-4}$-Cys; SEQ ID NO: 324) and bound water molecule for catalytic activity. The glutamic acid residue acts to activate the water molecule to a zinc hydroxide for nucleophilic attack in the deamination reaction. Each family member preferentially deaminates at its own particular "hotspot," for example, WRC (W is A or T, R is A or G) for hAID, TTC for hAPOBEC3F. A recent crystal structure of the catalytic domain of APOBEC3G revealed a secondary structure comprising a five-stranded β-sheet core flanked by six α-helices, which is believed to be conserved across the entire family. The active center loops have been shown to be responsible for both ssDNA binding and in determining "hotspot" identity. Overexpression of these enzymes has been linked to genomic instability and cancer, thus highlighting the importance of sequence-specific targeting. Another suitable cytosine deaminase is the activation-induced cytidine deaminase (AID), which is responsible for the maturation of antibodies by converting cytosines in ssDNA to uracils in a transcription-dependent, strand-biased fashion.

The term "base editors" or "nucleobase editors," as used herein, broadly refer to any of the fusion proteins described herein. In some embodiments, the nucleobase editors are capable of precisely deaminating a target base to convert it to a different base, e.g., the base editor may target C bases in a nucleic acid sequence and convert the C to a T. In some embodiments, the base editor comprises a Cas9 (e.g., dCas9 and nCas9), CasX, CasY, Cpf1, C2c1, C2c2, C2c3, or Argonaute protein fused to a cytidine deaminase. For example, in certain embodiments, the base editor may be a cytosine deaminase-dCas9 fusion protein. In some embodiments, the base editor may be a deaminase-dCas9-UGI fusion protein. In some embodiments, the base editor may be a APOBEC1-dCas9-UGI fusion protein. In some embodiments, the base editor may be APOBEC1-Cas9 nickase-UGI fusion protein. In some embodiments, the base editor may be APOBEC1-dCpf1-UGI fusion protein. In some embodiments, the base editor may be APOBEC1-dNgAgo-UGI fusion protein. In some embodiments, the base editor may be APOBEC1-SpCas9 nickase-UGI fusion protein. In some embodiments, the base editor may be APOBEC1-SaCas9 nickase-UGI fusion protein. In some embodiments, the base editor comprises a CasX protein fused to a cytidine deaminase. In some embodiments, the base editor comprises a CasY protein fused to a cytidine deaminase. In some embodiments, the base editor comprises a Cpf1 protein fused to a cytidine deaminase. In some embodiments, the base editor comprises a C2c1 protein fused to a cytidine deaminase. In some embodiments, the base editor comprises a C2c2 protein fused to a cytidine deaminase. In some embodiments, the base editor comprises a C2c3 protein fused to a cytidine deaminase. In some embodiments, the base editor comprises an Argonaute protein fused to a cytidine deaminase. In some embodiments, the fusion protein described herein comprises a Gam protein, a guide nucleotide sequence-programmable DNA binding protein, and a cytidine deaminase domain. In some embodiments, the base editor comprises a Gam protein, fused to a CasX protein, which is fused to a cytidine deaminase. In some embodiments, the base editor comprises a Gam protein, fused to a CasY protein, which is fused to a cytidine deaminase. In some embodiments, the base editor comprises a Gam protein, fused to a Cpf1 protein, which is fused to a cytidine deaminase. In some embodiments, the base editor comprises a Gam protein, fused to a C2c1 protein, which is fused to a cytidine deaminase. In some embodiments, the base editor comprises a Gam protein, fused to a C2c2 protein, which is fused to a cytidine deaminase. In some embodiments, the base editor comprises a Gam protein, fused to a C2c3 protein, which is fused to a cytidine deaminase. In some embodiments, the base editor comprises a Gam protein, fused to an Argonaute protein, which is fused to a cytidine deaminase. Non-limiting exemplary sequences of the nucleobase editors useful in the present disclosure are provided in Example 1, SEQ ID NOs: 1-260, 270-292, or 315-323. Such nucleobase editors and methods of using them for genome editing have been described in the art, e.g., in U.S. Pat. No. 9,068,179, US Patent Application Publications US20150166980, US20150166981, US20150166982, US20150166984, and US20150165054, and U.S. Provisional Applications, 62/245,828, 62/279,346, 62/311,763, 62/322,178, 62/357,352, 62/370,700, and 62/398,490 and in Komor et al., Nature, "Programmable editing of a target base in genomic DNA without double-stranded DNA cleavage," 533, 420-424 (2016), each of which is incorporated herein by reference.

The term "uracil glycosylase inhibitor" or "UGI," as used herein, refers to a protein that is capable of inhibiting a uracil-DNA glycosylase base-excision repair enzyme.

The term "Cas9 nickase," as used herein, refers to a Cas9 protein that is capable of cleaving only one strand of a duplexed nucleic acid molecule (e.g., a duplexed DNA molecule). In some embodiments, a Cas9 nickase comprises a D10A mutation and has a histidine at position H840 of a wild type sequence, or a corresponding mutation in any of the Cas9 proteins provided herein. For example, a Cas9 nickase may comprise the amino acid sequence as set forth in SEQ ID NO: 683. Such a Cas9 nickase has an active HNH nuclease domain and is able to cleave the non-targeted strand of DNA, i.e., the strand bound by the gRNA. Further, such a Cas9 nickase has an inactive RuvC nuclease domain and is not able to cleave the targeted strand of the DNA, i.e., the strand where base editing is desired.

Exemplary Cas9 nickase (Cloning vector pPlatTET-gRNA2; Accession No. BAV54124).

(SEQ ID NO: 683)

MDKKYSIGLAIGTNSVGWAVITDEYKVPSKKFKVLGNTDRHSIKKNLIGA

LLFDSGETAEATRLKRTARRRYTRRKNRICYLQEIFSNEMAKVDDSFFHR

LEESFLVEEDKKHERHPIFGNIVDEVAYHEKYPTIYHLRKKLVDSTDKAD

LRLIYLALAHMIKFRGHFLIEGDLNPDNSDVDKLFIQLVQTYNQLFEENP

INASGVDAKAILSARLSKSRRLENLIAQLPGEKKNGLFGNLIALSLGLTP

NFKSNFDLAEDAKLQLSKDTYDDDLDNLLAQIGDQYADLFLAAKNLSDAI

LLSDILRVNTEITKAPLSASMIKRYDEHHQDLTLLKALVRQQLPEKYKEI

FFDQSKNGYAGYIDGGASQEEFYKFIKPILEKMDGTEELLVKLNREDLLR

KQRTFDNGSIPHQIHLGELHAILRRQEDFYPFLKDNREKIEKILTFRIPY

YVGPLARGNSRFAWMTRKSEETITPWNFEEVVDKGASAQSFIERMTNFDK

NLPNEKVLPKHSLLYEYFTVYNELTKVKYVTEGMRKPAFLSGEQKKAIVD

LLFKTNRKVTVKQLKEDYFKKIECFDSVEISGVEDRFNASLGTYHDLLKI

IKDKDFLDNEENEDILEDIVLTLTLFEDREMIEERLKTYAHLFDDKVMKQ

LKRRRYTGWGRLSRKLINGIRDKQSGKTILDFLKSDGFANRNFMQLIHDD

SLTFKEDIQKAQVSGQGDSLHEHIANLAGSPAIKKGILQTVKVVDELVKV

MGRHKPENIVIEMARENQTTQKGQKNSRERMKRIEEGIKELGSQILKEHP

VENTQLQNEKLYLYYLQNGRDMYVDQELDINRLSDYDVDHIVPQSFLKDD

SIDNKVLTRSDKNRGKSDNVPSEEVVKKMKNYWRQLLNAKLITQRKFDNL

TKAERGGLSELDKAGFIKRQLVETRQITKHVAQILDSRMNTKYDENDKLI

REVKVITLKSKLVSDFRKDFQFYKVREINNYHHAHDAYLNAVVGTALIKK

YPKLESEFVYGDYKVYDVRKMIAKSEQEIGKATAKYFFYSNIMNFFKTEI

TLANGEIRKRPLIETNGETGEIVWDKGRDFATVRKVLSMPQVNIVKKTEV

QTGGFSKESILPKRNSDKLIARKKDWDPKKYGGFDSPTVAYSVLVVAKVE

KGKSKKLKSVKELLGITIMERSSFEKNPIDFLEAKGYKEVKKDLIIKLPK

YSLFELENGRKRMLASAGELQKGNELALPSKYVNFLYLASHYEKLKGSPE

DNEQKQLFVEQHKHYLDEIIEQISEFSKRVILADANLDKVLSAYNKHRDK

PIREQAENIIHLFTLTNLGAPAAFKYFDTTIDRKRYTSTKEVLDATLIHQ

SITGLYETRIDLSQLGGD

The term "target site" or "target sequence" refers to a sequence within a nucleic acid molecule (e.g., a DNA molecule) that is deaminated by the fusion protein (e.g., a dCas9-deaminase fusion protein or a Gam-nCas9-deaminase fusion protein) provided herein. In some embodiments, the target sequence is a polynucleotide (e.g., a DNA), wherein the polynucleotide comprises a coding strand and a complementary strand. The meaning of a "coding strand" and "complementary strand," as used herein, is the same as the common meaning of the terms in the art. In some embodiments, the target sequence is a sequence in the genome of a mammal. In some embodiments, the target sequence is a sequence in the genome of a human. In some embodiments, the target sequence is a sequence in the genome of a non-human animal. The term "target codon" refers to the amino acid codon that is edited by the base editor and converted to a different codon via deamination. The term "target base" refers to the nucleotide base that is edited by the base editor and converted to a different base via deamination. In some embodiments, the target codon in the coding strand is edited (e.g., deaminated). In some embodiments, the target codon in the complementary strand is edited (e.g., deaminated).

The term "linker," as used herein, refers to a chemical group or a molecule linking two molecules or moieties, e.g., two domains of a fusion protein, such as, for example, a nuclease-inactive Cas9 domain and a nucleic acid editing domain (e.g., a deaminase domain). In some embodiments, a linker joins a gRNA binding domain of an RNA-programmable nuclease, including a Cas9 nuclease domain, and a catalytic domain of a nucleic-acid editing domain (e.g., a deaminase domain). In some embodiments, a linker joins a Cas9 domain (e.g., a Cas9 nickase) and a Gam protein. In some embodiments, a linker joins a gRNA binding domain of an RNA-programmable nuclease (e.g., dCas9) and a UGI domain. In some embodiments, a linker joins a catalytic domain of a nucleic-acid editing domain (e.g., a deaminase domain) and a UGI domain. In some embodiments, a linker joins a catalytic domain of a nucleic-acid editing domain (e.g., a deaminase domain) and a Gam protein. In some embodiments, a linker joins a UGI domain and a Gam protein. Typically, the linker is positioned between, or flanked by, two groups, molecules, domains, or other moieties and connected to each one via a covalent bond, thus connecting the two. In some embodiments, the linker is an amino acid or a plurality of amino acids (e.g., a peptide or protein). In some embodiments, the linker is an organic molecule, group, polymer (e.g. a non-natural polymer, non-peptidic polymer), or chemical moiety. In some embodiments, the linker is 5-100 amino acids in length, for example, 5, 6, 7, 8, 9, 10, 11, 12, 13, 14, 15, 16, 17, 18, 19, 20, 21, 22, 23, 24, 25, 26, 27, 28, 29, 30, 30-35, 35-40, 40-45, 45-50, 50-60, 60-70, 70-80, 80-90, 90-100, 100-150, or 150-200 amino acids in length. Longer or shorter linkers are also contemplated. Linkers may be of any form known in the art. For example, the linker may be a linker from a website such as www[dot]ibi[dot]vu[dot]nl/programs/linkerdbwww/or from www[dot] ibi[dot]vu[dot]nl/programs/linkerdbwww/src/database.txt. The linkers may also be unstructured, structured, helical, or extended.

The term "mutation," as used herein, refers to a substitution of a residue within a sequence, e.g., a nucleic acid or amino acid sequence, with another residue, or a deletion or insertion of one or more residues within a sequence. Mutations are typically described herein by identifying the original residue followed by the position of the residue within the sequence and by the identity of the newly substituted residue. Various methods for making the amino acid substitutions (mutations) provided herein are well known in the art, and are provided by, for example, Green and Sambrook, *Molecular Cloning. A Laboratory Manual* (4$^{th}$ ed., Cold Spring Harbor Laboratory Press, Cold Spring Harbor, N.Y. (2012)).

The terms "nucleic acid," "polynucleotide," and "nucleic acid molecule," as used herein, refer to a compound comprising a nucleobase and an acidic moiety, e.g., a nucleoside, a nucleotide, or a polymer of nucleotides. Typically, polymeric nucleic acids, e.g., nucleic acid molecules comprising three or more nucleotides are linear molecules, in which adjacent nucleotides are linked to each other via a phosphodiester linkage. In some embodiments, "nucleic acid" refers to individual nucleic acid residues (e.g. nucleotides and/or nucleosides). In some embodiments, "nucleic acid" refers to an oligonucleotide chain comprising three or more individual nucleotide residues. As used herein, the terms "oligonucleotide" and "polynucleotide" can be used interchangeably to refer to a polymer of nucleotides (e.g., a string of at least three nucleotides). In some embodiments, "nucleic acid" encompasses RNA as well as single and/or double-stranded DNA. Nucleic acids may be naturally occurring, for example, in the context of a genome, a transcript, an mRNA, tRNA, rRNA, siRNA, snRNA, a plasmid, cosmid, chromosome, chromatid, or other naturally occurring nucleic acid molecule. On the other hand, a nucleic acid molecule may be a non-naturally occurring molecule, e.g., a recombinant DNA or RNA, an artificial chromosome, an engineered genome, or fragment thereof, or a synthetic DNA, RNA, DNA/RNA hybrid, or including non-naturally occurring nucleotides or nucleosides. Furthermore, the terms "nucleic acid," "DNA," "RNA," and/or similar terms include nucleic acid analogs, e.g., analogs having other than a phosphodiester backbone. Nucleic acids can be purified from natural sources, produced using recombinant expression systems and optionally purified, chemically synthesized, etc. Where appropriate, e.g., in the case of chemically synthesized molecules, nucleic acids can comprise nucleoside analogs such as analogs having chemically modified bases or sugars, and backbone modifications. A nucleic acid sequence is presented in the 5' to 3' direction unless otherwise indicated. In some embodiments, a nucleic acid is or comprises natural nucleosides (e.g. adenosine, thymidine, guanosine, cytidine, uridine, deoxyadenosine, deoxythymidine, deoxyguanosine, and deoxycytidine); nucleoside analogs (e.g., 2-aminoadenosine, 2-thiothymidine, inosine, pyrrolo-pyrimidine, 3-methyl adenosine, 5-methylcytidine, 2-aminoadenosine, C5-bromouridine, C5-fluorouridine, C5-iodouridine, C5-propynyl-uridine, C5-propynyl-cytidine, C5-methylcytidine, 2-aminoadenosine, 7-deazaadenosine, 7-deazaguanosine, 8-oxoadenosine, 8-oxoguanosine, 0(6)-methylguanine, and 2-thiocytidine); chemically modified bases; biologically modified bases (e.g., methylated bases); intercalated bases; modified sugars (e.g., 2'-fluororibose, ribose, 2'-deoxyribose, arabinose, and hexose); and/or modified phosphate groups (e.g., phosphorothioates and 5'-N-phosphoramidite linkages).

The terms "protein," "peptide," and "polypeptide" are used interchangeably herein, and refer to a polymer of amino acid residues linked together by peptide (amide) bonds. The terms refer to a protein, peptide, or polypeptide of any size, structure, or function. Typically, a protein, peptide, or polypeptide will be at least three amino acids long. A protein, peptide, or polypeptide may refer to an individual protein or a collection of proteins. One or more of the amino acids in a protein, peptide, or polypeptide may be modified, for example, by the addition of a chemical entity such as a carbohydrate group, a hydroxyl group, a phosphate group, a farnesyl group, an isofarnesyl group, a fatty acid group, a linker for conjugation, functionalization, or other modification, etc. A protein, peptide, or polypeptide may also be a single molecule or may be a multi-molecular complex. A protein, peptide, or polypeptide may be just a fragment of a naturally occurring protein or peptide. A protein, peptide, or polypeptide may be naturally occurring, recombinant, or synthetic, or any combination thereof. The term "fusion protein" as used herein refers to a hybrid polypeptide which comprises protein domains from at least two different proteins. One protein may be located at the amino-terminal (N-terminal) portion of the fusion protein or at the carboxy-terminal (C-terminal) protein thus forming an "amino-terminal fusion protein" or a "carboxy-terminal fusion protein," respectively. A protein may comprise different domains, for example, a nucleic acid binding domain (e.g., the gRNA binding domain of Cas9 that directs the binding of the protein to a target site) and a nucleic acid cleavage domain or a catalytic domain of a nucleic-acid editing protein. In some embodiments, a protein is in a complex with, or is in association with, a nucleic acid, e.g., RNA. Any of the proteins provided herein may be produced by any method known in the art. For example, the proteins provided herein may be produced via recombinant protein expression and purification, which is especially well suited for fusion proteins comprising a peptide linker. Methods for recombinant protein expression and purification are well known, and include those described by Green and Sambrook, *Molecular Cloning: A Laboratory Manual* (4$^{th}$ ed., Cold Spring Harbor Laboratory Press, Cold Spring Harbor, N.Y. (2012)), which is incorporated herein by reference.

The term "subject," as used herein, refers to an individual organism, for example, an individual mammal. In certain embodiments of the aspects described herein, the subject is a mammal, e.g., a primate, e.g., a human. In some embodiments, the subject is a non-human mammal. In some embodiments, the subject is a non-human primate. Non-human primates include, but are not limited to, chimpanzees, cynomologous monkeys, spider monkeys, and macaques, e.g., Rhesus. In some embodiments, the subject is any rodent, e.g., mice, rats, woodchucks, ferrets, rabbits and hamsters. In other embodiments, the subject is a domestic or game animal which includes, but is not limited to: cows, horses, pigs, deer, bison, buffalo, feline species, e.g., domestic cat, canine species, e.g., dog, fox, wolf, avian species, e.g., chicken, emu, ostrich, and fish, e.g., trout, catfish and salmon. In some embodiments, the subject is a sheep, a goat, a cattle, a cat, or a dog. In some embodiments, the subject is a research animal. In some embodiments, the subject is genetically engineered, e.g., a genetically engineered non-human subject. The subject may be of either sex and at any stage of development. For example, a subject may be male or female, and can be a fully developed subject (e.g., an adult) or a subject undergoing the developmental process (e.g., a child, infant or fetus). The term "patient" or "subject" includes any subset of the foregoing, e.g., all of the above, but excluding one or more groups or species such as humans, primates or rodents. The terms, "patient" and "subject" are used interchangeably herein.

The term "recombinant" as used herein in the context of proteins or nucleic acids refers to proteins or nucleic acids that do not occur in nature, but are the product of human engineering. For example, in some embodiments, a recombinant protein or nucleic acid molecule comprises an amino acid or nucleotide sequence that comprises at least one, at least two, at least three, at least four, at least five, at least six, or at least seven mutations as compared to any naturally occurring sequence. The fusion proteins (e.g., base editors) described herein are made recombinantly. Recombinant technology is familiar to those skilled in the art.

An "intron" refers to any nucleotide sequence within a gene that is removed by RNA splicing during maturation of the final RNA product. The term intron refers to both the DNA sequence within a gene and the corresponding sequence in RNA transcripts. Sequences that are joined together in the final mature RNA after RNA splicing are exons. Introns are found in the genes of most organisms and many viruses, and can be located in a wide range of genes, including those that generate proteins, ribosomal RNA (rRNA), and transfer RNA (tRNA). When proteins are generated from intron-containing genes, RNA splicing takes place as part of the RNA processing pathway that follows transcription and precedes translation.

An "exon" refers to any part of a gene that will become a part of the final mature RNA produced by that gene after introns have been removed by RNA splicing. The term exon refers to both the DNA sequence within a gene and to the corresponding sequence in RNA transcripts. In RNA splicing, introns are removed and exons are covalently joined to one another as part of generating the mature messenger RNA.

"Splicing" refers to the processing of a newly synthesized messenger RNA transcript (also referred to as a primary mRNA transcript). After splicing, introns are removed and exons are joined together (ligated) for form mature mRNA molecule containing a complete open reading frame that is decoded and translated into a protein. For nuclear-encoded genes, splicing takes place within the nucleus either co-transcriptionally or immediately after transcription. The molecular mechanism of RNA splicing has been extensively described, e.g., in Pagani et al., *Nature Reviews Genetics* 5, 389-396, 2004; Clancy et al., *Nature Education* 1 (1): 31, 2011; Cheng et al., *Molecular Genetics and Genomics* 286 (5-6): 395-410, 2014; Taggart et al., *Nature Structural & Molecular Biology* 19 (7): 719-2, 2012, the contents of each of which are incorporated herein by reference. One skilled in the art is familiar with the mechanism of RNA splicing.

"Alternative splicing" refers to a regulated process during gene expression that results in a single gene coding for multiple proteins. In this process, particular exons of a gene may be included within or excluded from the final, processed messenger RNA (mRNA) produced from that gene. Consequently, the proteins translated from alternatively spliced mRNAs will contain differences in their amino acid sequence and, often, in their biological functions. Notably, alternative splicing allows the human genome to direct the synthesis of many more proteins than would be expected from its 20,000 protein-coding genes. Alternative splicing is sometimes also termed differential splicing. Alternative splicing occurs as a normal phenomenon in eukaryotes, where it greatly increases the biodiversity of proteins that can be encoded by the genome; in humans, ~95% of multi-exonic genes are alternatively spliced. There are numerous modes of alternative splicing observed, of which the most common is exon skipping. In this mode, a particular exon may be included in mRNAs under some conditions or in particular tissues, and omitted from the mRNA in others. Abnormal variations in splicing are also implicated in disease; a large proportion of human genetic disorders result from splicing variants. Abnormal splicing variants are also thought to contribute to the development of cancer, and splicing factor genes are frequently mutated in different types of cancer. The regulation of alternative splicing is also described in the art, e.g., in Douglas et al., *Annual Review of Biochemistry* 72 (1): 291-336, 2003; Pan et al., *Nature Genetics* 40 (12): 1413-1415, 2008; Martin et al., *Nature Reviews* 6 (5): 386-398, 2005; Skotheim et al., *The International Journal of Biochemistry & Cell Biology* 39 (7-8): 1432-49, 2007, each of which is incorporated herein by reference.

A "coding frame" or "open reading frame" refers to a stretch of codons that encodes a polypeptide. Since DNA is interpreted in groups of three nucleotides (codons), a DNA strand has three distinct reading frames. The double helix of a DNA molecule has two anti-parallel strands so, with the two strands having three reading frames each, there are six possible frame translations. A functional protein may be produced when translation proceeds in the correct coding frame. An insertion or a deletion of one or two bases in the open reading frame causes a shift in the coding frame that is also referred to as a "frameshift mutation." A frameshift mutation typical results in premature translation termination and/or truncated or non-functional protein.

These and other exemplary substituents are described in more detail in the Detailed Description, Examples, and Claims. The methods and compositions disclosed herein are not intended to be limited in any manner by the above exemplary listing of substituents.

DETAILED DESCRIPTION OF CERTAIN EMBODIMENTS

Disclosed herein are novel genome/base-editing systems, methods, and compositions for generating engineered and naturally-occurring protective variants of the C—C Chemokine Receptor 5 (CCR5) protein to protect against human immunodeficiency virus (HIV) infection and acquired immune deficiency syndrome (AIDS). C—C Chemokine Receptor 5 (CCR5), also known as cluster of differentiation-195 (CD195), is a member of the beta chemokine receptor family. This protein is expressed by macrophages, dendritic cells, and memory T cells in the immune system; endothelial cells, epithelial cells, vascular smooth muscle cells, and fibroblasts; and microglia, neurons, and astrocytes in the central nervous system. See, e.g., Barmania and Pepper, *Applied & Translational Genomics* 2 (2013) 3-16, each of which is incorporated herein by reference. Macrophage-tropic (M-tropic) strains of HIV (e.g., M-tropic strains of HIV-1) can bind CCR5 in order to enter host cells.

Certain alleles of CCR5 have been associated with resistance to HIV infection. As one example, CCR5-Δ32 (also known as CCR5-D32, CCR5Δ32, or CCR5 delta 32) is a 32-base-pair deletion that introduces a premature stop codon into the CCR5 receptor locus, resulting in a non-functional receptor. CCR5-Δ32 has a heterozygote allele frequency of 10% and a homozygote frequency of 1% in Europe. Individuals who are homozygous for CCR5-Δ32 do not express functional CCR5 receptors on their cell surfaces and are resistant to HIV-1 infection (see, for example, Liu et al., (August 1996). "Homozygous defect in HIV-1 coreceptor accounts for resistance of some multiply-exposed individuals to HIV-1 infection". Cell. 86 (3): 367-77). Individuals heterozygous for CCR5-Δ32 have a greater than 50% reduction in functional CCR5 receptors on their cell surfaces which interferes with transport of CCR5 to the cell surface. This level of reduction is due to the dimerization of mutant and wild-type receptors (see, for example, Benkirane et al., (December 1997). "Mechanism of transdominant inhibition of CCR5-mediated HIV-1 infection by ccr5delta32". *The Journal of Biological Chemistry*. 272 (49): 30603-6). These heterozygous individuals are resistant to HIV-1 infection and, if infected, exhibit reduced viral loads and a two to three year delay in the development of AIDS (relative to individuals with two wild type CCR5 genes; see, for example, Dean M et al., (September 1996). "Genetic restriction of HIV-1 infection and progression to AIDS by a deletion allele of the CKR5 structural gene. Hemophilia Growth and Development Study, Multicenter AIDS Cohort Study, Multicenter Hemophilia Cohort Study, San Francisco City Cohort, ALIVE Study". *Science*. 273 (5283): 1856-62; Liu et al., (August 1996). "Homozygous defect in HIV-1 coreceptor accounts for resistance of some multiply-exposed individuals to HIV-1 infection". Cell. 86 (3): 367-77; Michael N L et al., (October 1997). "The role of CCR5 and CCR2 polymorphisms in HIV-1 transmission and disease progression". *Nature Medicine*. 3 (10): 1160-2). Further, individuals who are homozygous for CCR5-Δ32 also display an improved response to anti-retroviral treatment (see, for example, Laurichesse et al., (May 2007). "Improved virological response to highly active antiretroviral therapy in HIV-1-infected patients carrying the CCR5 Delta32 deletion." *HIV Medicine*. 8 (4): 213-9).

The mRNA sequence for human CCR5, which encodes a 352 amino acid protein, can be found under GenBank Accession No. NM_000579.3 (transcript variant A) or GenBank Accession No. NM_001100168.1 (transcript variant B). Mouse and rat CCR5 mRNA sequences have been deposited and can be found under GenBank Accession Nos.: NM_009917.5 and NM_053960.3, respectively. The wild-type CCR5 human, mouse, and rat protein sequences can be found under GenBank Accession Nos.: NP_001093638.1, NP_034047.2, and NP_446412.2, respectively.

```
Wild type CCR5 Gene (>gi|154091329|ref|NM_000579.
3| Homo sapiens C-C motif chemokine receptor 5
(gene/pseudogene)(CCR5), transcript variant A,
mRNA, SEQ ID NO: 325)
CTTCAGATAGATTATATCTGGAGTGAAGAATCCTGCCACCTATGTATCTG

GCATAGTATTCTGTGTAGTGGGATGAGCAGAGAACAAAAACAAAATAATC

CAGTGAGAAAAGCCCGTAAATAAACCTTCAGACCAGAGATCTATTCTCTA

GCTTATTTTAAGCTCAACTTAAAAAGAAGAACTGTTCTCTGATTCTTTTC

GCCTTCAATACACTTAATGATTTAACTCCACCCTCCTTCAAAAGAAACAG

CATTTCCTACTTTTATACTGTCTATATGATTGATTTGCACAGCTCATCTG

GCCAGAAGAGCTGAGACATCCGTTCCCCTACAAGAAACTCTCCCCGGGTG

GAACAAGATGGATTATCAAGTGTCAAGTCCAATCTATGACATCAATTATT

ATACATCGGAGCCCTGCCAAAAAATCAATGTGAAGCAAATCGCAGCCCGC

CTCCTGCCTCCGCTCTACTCACTGGTGTTCATCTTTGGTTTTGTGGGCAA

CATGCTGGTCATCCTCATCCTGATAAACTGCAAAAGGCTGAAGAGCATGA

CTGACATCTACCTGCTCAACCTGGCCATCTCTGACCTGTTTTTCCTTCTT

ACTGTCCCCTTCTGGGCTCACTATGCTGCCGCCCAGTGGGACTTTGGAAA

TACAATGTGTCAACTCTTGACAGGGCTCTATTTTATAGGCTTCTTCTCTG

GAATCTTCTTCATCATCCTCCTGACAATCGATAGGTACCTGGCTGTCGTC

CATGCTGTGTTTGCTTTAAAAGCCAGGACGGTCACCTTTGGGGTGGTGAC

AAGTGTGATCACTTGGGTGGTGGCTGTGTTTGCGTCTCTCCCAGGAATCA

TCTTTACCAGATCTCAAAAAGAAGGTCTTCATTACACCTGCAGCTCTCAT

TTTCCATACAGTCAGTATCAATTCTGGAAGAATTTCCAGACATTAAAGAT

AGTCATCTTGGGGCTGGTCCTGCCGCTGCTTGTCATGGTCATCTGCTACT

CGGGAATCCTAAAAACTCTGCTTCGGTGTCGAAATGAGAAGAAGAGGCAC

AGGGCTGTGAGGCTTATCTTCACCATCATGATTGTTTATTTTCTCTTCTG

GGCTCCCTACAACATTGTCCTTCTCCTGAACACCTTCCAGGAATTCTTTG

GCCTGAATAATTGCAGTAGCTCTAACAGGTTGGACCAAGCTATGCAGGTG

ACAGAGACTCTTGGGATGACGCACTGCTGCATCAACCCCATCATCTATGC

CTTTGTCGGGGAGAAGTTCAGAAACTACCTCTTAGTCTTCTTCCAAAAGC

ACATTGCCAAACGCTTCTGCAAATGCTGTTCTATTTTCCAGCAAGAGGCT

CCCGAGCGAGCAAGCTCAGTTTACACCCGATCCACTGGGGAGCAGGAAAT

ATCTGTGGGCTTGTGACACGGACTCAAGTGGGCTGGTGACCCAGTCAGAG

TTGTGCACATGGCTTAGTTTTCATACACAGCCTGGGCTGGGGGTGGGGTG

GGAGAGGTCTTTTTTAAAAGGAAGTTACTGTTATAGAGGGTCTAAGATTC

ATCCATTTATTTGGCATCTGTTTAAAGTAGATTAGATCTTTTAAGCCCAT

CAATTATAGAAAGCCAAATCAAAATATGTTGATGAAAAATAGCAACCTTT

TTATCTCCCCTTCACATGCATCAAGTTATTGACAAACTCTCCCTTCACTC

CGAAAGTTCCTTATGTATATTTAAAAGAAAGCCTCAGAGAATTGCTGATT

CTTGAGTTTAGTGATCTGAACAGAAATACCAAAATTATTTCAGAAATGTA

CAACTTTTTACCTAGTACAAGGCAACATATAGGTTGTAAATGTGTTTAAA

ACAGGTCTTTGTCTTGCTATGGGGAGAAAAGACATGAATATGATTAGTAA

AGAAATGACACTTTTCATGTGTGATTTCCCCTCCAAGGTATGGTTAATAA

GTTTCACTGACTTAGAACCAGGCGAGAGACTTGTGGCCTGGGAGAGCTGG

GGAAGCTTCTTAAATGAGAAGGAATTTGAGTTGGATCATCTATTGCTGGC

AAAGACAGAAGCCTCACTGCAAGCACTGCATGGGCAAGCTTGGCTGTAGA

AGGAGACAGAGCTGGTTGGGAAGACATGGGGAGGAAGGACAAGGCTAGAT

CATGAAGAACCTTGACGGCATTGCTCCGTCTAAGTCATGAGCTGAGCAGG

GAGATCCTGGTTGGTGTTGCAGAAGGTTTACTCTGTGGCCAAAGGAGGGT

CAGGAAGGATGAGCATTTAGGGCAAGGAGACCACCAACAGCCCTCAGGTC

AGGGTGAGGATGGCCTCTGCTAAGCTCAAGGCGTGAGGATGGGAAGGAGG

GAGGTATTCGTAAGGATGGGAAGGAGGGAGGTATTCGTGCAGCATATGAG

GATGCAGAGTCAGCAGAACTGGGGTGGATTTGGGTTGGAAGTGAGGGTCA

GAGAGGAGTCAGAGAGAATCCCTAGTCTTCAAGCAGATTGGAGAAACCCT

TGAAAAGACATCAAGCACAGAAGGAGGAGGAGGAGGTTTAGGTCAAGAAG

AAGATGGATTGGTGTAAAAGGATGGGTCTGGTTTGCAGAGCTTGAACACA

GTCTCACCCAGACTCCAGGCTGTCTTTCACTGAATGCTTCTGACTTCATA

GATTTCCTTCCCATCCCAGCTGAAATACTGAGGGGTCTCCAGGAGGAGAC

TAGATTTATGAATACACGAGGTATGAGGTCTAGGAACATACTTCAGCTCA

CACATGAGATCTAGGTGAGGATTGATTACCTAGTAGTCATTTCATGGGTT

GTTGGGAGGATTCTATGAGGCAACCACAGGCAGCATTTAGCACATACTAC

ACATTCAATAAGCATCAAACTCTTAGTTACTCATTCAGGGATAGCACTGA

GCAAAGCATTGAGCAAAGGGGTCCCATAGAGGTGAGGGAAGCCTGAAAAA

CTAAGATGCTGCCTGCCCAGTGCACACAAGTGTAGGTATCATTTTCTGCA

TTTAACCGTCAATAGGCAAAGGGGGGAAGGGACATATTCATTTGGAAATA

AGCTGCCTTGAGCCTTAAAACCCACAAAAGTACAATTTACCAGCCTCCGT

ATTTCAGACTGAATGGGGGTGGGGGGGCGCCTTAGGTACTTATTCCAGA

TGCCTTCTCCAGACAAACCAGAAGCAACAGAAAAAATCGTCTCTCCCTCC

CTTTGAAATGAATATACCCCTTAGTGTTTGGGTATATTCATTTCAAAGGG

AGAGAGAGAGGTTTTTTTCTGTTCTGTCTCATATGATTGTGCACATACTT

GAGACTGTTTTGAATTTGGGGGATGGCTAAAACCATCATAGTACAGGTAA

GGTGAGGGAATAGTAAGTGGTGAGAACTACTCAGGGAATGAAGGTGTCAG

AATAATAAGAGGTGCTACTGACTTTCTCAGCCTCTGAATATGAACGGTGA
```

```
GCATTGTGGCTGTCAGCAGGAAGCAACGAAGGGAAATGTCTTTCCTTTTG

CTCTTAAGTTGTGGAGAGTGCAACAGTAGCATAGGACCCTACCCTCTGGG

CCAAGTCAAAGACATTCTGACATCTTAGTATTTGCATATTCTTATGTATG

TGAAAGTTACAAATTGCTTGAAAGAAAATATGCATCTAATAAAAAACACC

TTCTAAAATAAAAAAAAAAAAAAAAAAAAAAAAAAA
```

Wild type CCR5 Gene, transcript variant B (>gi|
154091327|ref|NM_001100168.1| Homo sapiens C-C
motif chemokine receptor 5 (gene/pseudogene)
(CCR5), transcript variant B, mRNA, SEQ ID NO:
326)

```
CTTCAGATAGATTATATCTGGAGTGAAGAATCCTGCCACCTATGTATCTG

GCATAGTCTCATCTGGCCAGAAGAGCTGAGACATCCGTTCCCCTACAAGA

AACTCTCCCCGGGTGGAACAAGATGGATTATCAAGTGTCAAGTCCAATCT

ATGACATCAATTATTATACATCGGAGCCCTGCCAAAAAATCAATGTGAAG

CAAATCGCAGCCCGCCTCCTGCCTCCGCTCTACTCACTGGTGTTCATCTT

TGGTTTTGTGGGCAACATGCTGGTCATCCTCATCCTGATAAACTGCAAAA

GGCTGAAGAGCATGACTGACATCTACCTGCTCAACCTGGCCATCTCTGAC

CTGTTTTTCCTTCTTACTGTCCCCTTCTGGGCTCACTATGCTGCCGCCCA

GTGGGACTTTGGAAATACAATGTGTCAACTCTTGACAGGGCTCTATTTTA

TAGGCTTCTTCTCTGGAATCTTCTTCATCATCCTCCTGACAATCGATAGG

TACCTGGCTGTCGTCCATGCTGTGTTTGCTTTAAAAGCCAGGACGGTCAC

CTTTGGGGTGGTGACAAGTGTGATCACTTGGGTGGTGGCTGTGTTTGCGT

CTCTCCCAGGAATCATCTTTACCAGATCTCAAAAAGAAGGTCTTCATTAC

ACCTGCAGCTCTCATTTTCCATACAGTCAGTATCAATTCTGGAAGAATTT

CCAGACATTAAAGATAGTCATCTTGGGGCTGGTCCTGCCGCTGCTTGTCA

TGGTCATCTGCTACTCGGGAATCCTAAAAACTCTGCTTCGGTGTCGAAAT

GAGAAGAAGAGGCACAGGGCTGTGAGGCTTATCTTCACCATCATGATTGT

TTATTTTCTCTTCTGGGCTCCCTACAACATTGTCCTTCTCCTGAACACCT

TCCAGGAATTCTTTGGCCTGAATAATTGCAGTAGCTCTAACAGGTTGGAC

CAAGCTATGCAGGTGACAGAGACTCTTGGGATGACGCACTGCTGCATCAA

CCCCATCATCTATGCCTTTGTCGGGGAGAAGTTCAGAAACTACCTCTTAG

TCTTCTTCCAAAAGCACATTGCCAAACGCTTCTGCAAATGCTGTTCTATT

TTCCAGCAAGAGGCTCCCGAGCGAGCAAGCTCAGTTTACACCCGATCCAC

TGGGGAGCAGGAAATATCTGTGGGCTTGTGACACGGACTCAAGTGGGCTG

GTGACCCAGTCAGAGTTGTGCACATGGCTTAGTTTTCATACACAGCCTGG

GCTGGGGGTGGGGTGGGAGAGGTCTTTTTTAAAAGGAAGTTACTGTTATA

GAGGGTCTAAGATTCATCCATTTATTTGGCATCTGTTTAAAGTAGATTAG

ATCTTTTAAGCCCATCAATTATAGAAAGCCAAATCAAAATATGTTGATGA

AAAATAGCAACCTTTTTATCTCCCCTTCACATGCATCAAGTTATTGACAA

ACTCTCCCTTCACTCCGAAAGTTCCTTATGTATATTTAAAAGAAAGCCTC

AGAGAATTGCTGATTCTTGAGTTTAGTGATCGAACAGAAATACCAAAAT

TATTTCAGAAATGTACAACTTTTTACCTAGTACAAGGCAACATATAGGTT

GTAAATGTGTTTAAAACAGGTCTTTGTCTTGCTATGGGGAGAAAAGACAT

GAATATGATTAGTAAAGAAATGACACTTTTCATGTGTGATTTCCCCTCCA

AGGTATGGTTAATAAGTTTCACTGACTTAGAACCAGGCGAGAGACTTGTG

GCCTGGGAGAGCTGGGGAAGCTTCTTAAATGAGAAGGAATTTGAGTTGGA

TCATCTATTGCTGGCAAAGACAGAAGCCTCACTGCAAGCACTGCATGGGC

AAGCTTGGCTGTAGAAGGAGACAGAGCTGGTTGGGAAGACATGGGGAGGA

AGGACAAGGCTAGATCATGAAGAACCTTGACGGCATTGCTCCGTCTAAGT

CATGAGCTGAGCAGGGAGATCCTGGTTGGTGTTGCAGAAGGTTTACTCTG

TGGCCAAAGGAGGGTCAGGAAGGATGAGCATTTAGGGCAAGGAGACCACC

AACAGCCCTCAGGTCAGGGTGAGGATGGCCTCTGCTAAGCTCAAGGCGTG

AGGATGGGAAGGAGGGAGGTATTCGTAAGGATGGGAAGGAGGGAGGTATT

CGTGCAGCATATGAGGATGCAGAGTCAGCAGAACTGGGGTGGATTTGGGT

TGGAAGTGAGGGTCAGAGAGGAGTCAGAGAGAATCCCTAGTCTTCAAGCA

GATTGGAGAAACCCTTGAAAAGACATCAAGCACAGAAGGAGGAGGAGGAG

GTTTAGGTCAAGAAGAAGATGGATTGGTGTAAAAGGATGGGTCTGGTTTG

CAGAGCTTGAACACAGTCTCACCCAGACTCCAGGCTGTCTTTCACTGAAT

GCTTCTGACTTCATAGATTTCCTTCCCATCCCAGCTGAAATACTGAGGGG

TCTCCAGGAGGAGACTAGATTTATGAATACACGAGGTATGAGGTCTAGGA

ACATACTTCAGCTCACACATGAGATCTAGGTGAGGATTGATTACCTAGTA

GTCATTTCATGGGTTGTTGGGAGGATTCTATGAGGCAACCACAGGCAGCA

TTTAGCACATACTACACATTCAATAAGCATCAAACTCTTAGTTACTCATT

CAGGGATAGCACTGAGCAAAGCATTGAGCAAAGGGGTCCCATAGAGGTGA

GGGAAGCCTGAAAAACTAAGATGCTGCCTGCCCAGTGCACACAAGTGTAG

GTATCATTTTCTGCATTTAACCGTCAATAGGCAAAGGGGGGAAGGGACAT

ATTCATTTGGAAATAAGCTGCCTTGAGCCTTAAAACCCACAAAAGTACAA

TTTACCAGCCTCCGTATTTCAGACTGAATGGGGGTGGGGGGGCGCCTTA

GGTACTTATTCCAGATGCCTTCTCCAGACAAACCAGAAGCAACAGAAAAA

ATCGTCTCTCCCTCCCTTTGAAATGAATATACCCCTTAGTGTTTGGGTAT

ATTCATTTCAAAGGGAGAGAGAGAGGTTTTTTTCTGTTCTGTCTCATATG

ATTGTGCACATACTTGAGACTGTTTTGAATTTGGGGGATGGCTAAAACCA

TCATAGTACAGGTAAGGTGAGGGAATAGTAAGTGGTGAGAACTACTCAGG

GAATGAAGGTGTCAGAATAATAAGAGGTGCTACTGACTTTCTCAGCCTCT

GAATATGAACGGTGAGCATTGTGGCTGTCAGCAGGAAGCAACGAAGGGAA

ATGTCTTTCCTTTTGCTCTTAAGTTGTGGAGAGTGCAACAGTAGCATAGG

ACCCTACCCTCTGGGCCAAGTCAAAGACATTCTGACATCTTAGTATTTGC

ATATTCTTATGTATGTGAAAGTTACAAATTGCTTGAAAGAAAATATGCAT

CTAATAAAAACACCTTCTAAAATAAAAAAAAAAAAAAAAAAAAAAAAAA

A
```

Human CCR5 Amino Acid Sequence (>gi|154091328|ref|
NP_001093638.1|C-C chemokine receptor type 5
[Homo sapiens], SEQ ID NO: 327)
MDYQVSSPIYDINYYTSEPCQKINVKQIAARLLPPLYSLVFIFGFVGNML

VILILINCKRLKSMTDIYLLNLAISDLFFLLTVPFWAHYAAAQWDFGNTM

-continued

CQLLTGLYFIGFFSGIFFIILLTIDRYLAVVHAVFALKARTVTFGVVTSV

ITWVVAVFASLPGIIFTRSQKEGLHYTCSSHFPYSQYQFWKNFQTLKIVI

LGLVLPLLVMVICYSGILKTLLRCRNEKKRHRAVRLIFTIMIVYFLFWAP

YNIVLLLNTFQEFFGLNNCSSSNRLDQAMQVTETLGMTHCCINPIIYAFV

GEKFRNYLLVFFQKHIAKRFCKCCSIFQQEAPERASSVYTRSTGEQEISV

GL

Mouse CCR5 Amino Acid Sequence (>gi|31542356|ref|
NP_034047.2|C-C chemokine receptor type 5 [Mus
musculus], SEQ ID NO: 328)
MDFQGSVPTYSYDIDYGMSAPCQKINVKQIAAQLLPPLYSLVFIFGFVGN

MMVFLILISCKKLKSVTDIYLLNLAISDLLFLLTLPFWAHYAANEWVFGN

IMCKVFTGLYHIGYFGGIFFIILLTIDRYLAIVHAVFALKVRTVNFGVIT

SVVTWAVAVFASLPEIIFTRSQKEGFHYTCSPHFPHTQYHFWKSFQTLKM

VILSLILPLLVMVICYSGILHTLFRCRNEKKRHRAVRLIFAIMIVYFLFW

TPYNIVLLLTTFQEFFGLNNCSSSNRLDQAMQATETLGMTHCCLNPVIYA

FVGEKFRSYLSVFFRKHMVKRFCKRCSIFQQDNPDRASSVYTRSTGEHEV

STGL

Rat CCR5 Amino Acid Sequence (>gi|51592090|ref|
NP_446412.2|C-C chemokine receptor type 5 [Rattus
norvegicus], SEQ ID NO: 329)
MDFQGSIPTYIYDIDYSMSAPCQKFNVKQIAAQLLPPLYSLVFIFGFVGN

MMVFLILISCKKLKSMTDIYLFNLAISDLLFLLTLPFWAHYAANEWVFGN

IMCKLFTGIYHIGYFGGIFFIILLTIDRYLAIVHAVFAIKARTVNFGVIT

SVVTWVVAVFVSLPEIIFMRSQKEGSHYTCSPHFPRIQYRFWKHFQTLKM

VILSLILPLLVMVICYSGILNTLFRCRNEKKRHRAVRLIFAIMIVYFLFW

TPYNIVLLLTTFQEYFGLNNCSSSNRLDQAMQVTETLGMTHCCLNPVIYA

FVGEKFRNYLSVFFRKHIVKRFCKHCSIFQQVNPDRVSSVYTRSTGEQEV

STGL

Strategies for Generating CCR5 Mutants

Some aspects of the present disclosure provide systems, compositions, and methods of editing polynucleotides encoding the CCR5 protein to introduce mutations into the CCR5 gene. The gene editing methods described herein, rely on nucleobase editors as described in U.S. Pat. No. 9,068, 179, US Patent Application Publications US20150166980, US20150166981, US20150166982, US20150166984, and US20150165054, and U.S. Provisional Applications 62/245, 828, 62/279,346, 62/311,763, 62/322,178, 62/357,352, 62/370,700, and 62/398,490, and in Komor et al., Nature, Programmable editing of a target base in genomic DNA without double-stranded DNA cleavage, 533, 420-424 (2016), each of which are incorporated herein by reference.

The nucleobase editors are highly efficient at precisely editing a target base in the CCR5 gene, and a DNA double stand break is not necessary for the gene editing, thus reducing genome instability and preventing possible oncogenic modifications that may be caused by other genome editing methods. The nucleobase editors described herein may be programmed to target and modify a single base. In some embodiments, the target base is a cytosine (C) base and may be converted to a thymine (T) base via deamination by the nucleobase editor.

To edit the polynucleotide encoding the CCR5 protein, the polynucleotide is contacted with a nucleobase editors described herein. In some embodiments, the CCR5-encoding polynucleotide is contacted with a nucleobase editor and a guide nucleotide sequence, wherein the guide nucleotide sequence targets the nucleobase editor to the target base (e.g., a C base) in the CCR5-encoding polynucleotide.

In some embodiments, the CCR5-encoding polynucleotide is the CCR5 gene locus in the genomic DNA of a cell. In some embodiments, the cell is a cultured cell. In some embodiments, the cell is in vivo. In some embodiments, the cell is in vitro. In some embodiments, the cell is ex vivo. In some embodiments, the cell is from a mammal. In some embodiments, the mammal is a human. In some embodiments, the mammal is a rodent. In some embodiments, the rodent is a mouse. In some embodiments, the rodent is a rat.

As would be understood be those skilled in the art, the CCR5-encoding polynucleotide may be a DNA molecule comprising a coding strand and a complementary strand, e.g., the CCR5 gene locus in a genome. As such, the CCR5-encoding polynucleotide may also include coding regions (e.g., exons) and non-coding regions (e.g., introns or splicing sites). In some embodiments, the target base (e.g., a C base) is located in a coding region (e.g., an exon) of the CCR5-encoding polynucleotide (e.g., the CCR5 gene locus). As such, the conversion of a base in the coding region may result in an amino acid change in the CCR5 protein sequence, i.e., a mutation. In some embodiments, the mutation is a loss of function mutation. In some embodiments, the CCR5 loss-of-function mutation is identical (or similar) to a naturally occurring CCR5 loss-of-function mutation, e.g., D2V (D2N), C20S (C20Y), C101X (C101Y), G106R, C178R (C178Y), R223Q, C269F (C269Y). In some embodiments, the loss-of-function mutation is engineered (i.e., not naturally occurring), e.g., Q4X, P19S, P19L, Q21X, P34S, P34L, P35S, P35L, G44R, G44D, G44S, G47R, G47D, G47S, W86X, Q93X, W94X, Q102X, G111R, G111D, G115R, G115D, G115E, G145R, G145E, S149N, G163R, G163E, S149N, P162S, P162L, G163R, G163D, G163E, P183S, P183L, Q186X, Q188X, W190X, G202R, G202E, P206S, P206L, G216S, G216D, W248X, Q261X, Q277X, Q280X, E283R, E283K, C290T, C290Y, C291Y, C291T, P293S, P293L, Q328X, Q329X, P332S, P332L, R334X, A335V, R341X. This engineered mutation may be an engineered truncation.

In some embodiments, the target base is located in a non-coding region of the CCR5 gene, e.g., in an intron or a splicing site. In some embodiments, a target base is located in a splicing site and the editing of such target base causes alternative splicing of the CCR5 mRNA. In some embodiments, the alternative splicing leads to loss-of-function CCR5 mutants. In some embodiments, the alternative splicing leads to the introduction of a premature stop codon in a CCR5 mRNA, resulting in truncated and unstable CCR5 proteins. In some embodiments, CCR5 mutants that are defective in terms of folding are produced.

CCR5 variants that are particularly useful in creating using the present disclosure are variants that may increase resistance to infection by human immunodeficiency virus (HIV), prevent infection by HIV, delay the onset of AIDS, and/or slow the progression of AIDS. In some embodiments, the CCR5 variants are loss-of-function variants produced using the methods of the present disclosure express efficiently in a cell. As described herein, a loss-of function CCR5 variant may have reduced activity or levels (e.g., the CCR5 variant may not be folded correctly, may not be transported to the membrane, may demonstrate reduced binding to a ligand including RANTES, MIP-1β, or MIP-1α, may demonstrate reduced transduction of signals through the G-proteins, or may have a reduced interaction with HIV) compared to a wild type CCR5 protein. For example, the activity or levels of a loss-of-function CCR5 variant may be reduced by at least 20%, at least 30%, at least 40%, at least 50%, at least 60%, at least 70%, at least 80%, at least 90%, at least 99%, or more. In some embodiments, the loss-of-function CCR5 variant has no more than 50%, no more than 40%, no more than 30%, no more than 20%, no more than 10%, no more than 5%, no more than 1%, or less activity (e.g., the CCR5 variant may not be folded correctly, may not be transported to the membrane, may demonstrate reduced binding to a ligand including RANTES, MIP-1β, or MIP-1α, may demonstrate reduced transduction of signals through the G-proteins, or may have a reduced interaction with HIV) compared to a wild type CCR5 protein. In other embodiments, the loss-of-function CCR5 variant inhibits the spread of HIV infection from cell to cell either in vitro or in vivo by more than 90%, more than 80%, more than 70%, more than 60%, more than 50%, more than 40%, more than 30%, more than 20%, or more than 10% compared to a wild type CCR5 protein. Non-limiting, exemplary assays for determining CCR5 activity may be demonstrated by any known methodology, such as the assay for chemokine binding as disclosed by Van Riper et al., *J. Exp. Med.*, 177, 851-856 (1993), which may be readily adapted for measurement of CCR5 binding, which is incorporated herein by reference. Non-limiting, exemplary assays for determining inhibition of the spread of HIV infection between cells may be demonstrated by methods known in the art, such as the HIV quantitation assay disclosed by Nunberg, et al., *J. Virology*, 65 (9), 4887-4892 (1991).

To change the CCR5 gene, the nucleobase editor interacts with the CCR5 gene (a polynucleotide molecule), wherein the nucleobase editor binds to its target sequence and edits the desired nucleobase. For example, the nucleobase editor may be expressed in a cell where CCR5 gene editing is desired (e.g., macrophages, dendritic cells, and memory T cells of the immune system; endothelial cells, epithelial cells, vascular smooth muscle cells, and fibroblasts; and microglia, neurons, and astrocytes in the central nervous system), to thereby allowing interaction of the CCR5 gene with the nucleobase editor. In some embodiments, the binding of the nucleobase editor to its target sequence in the CCR5 is mediated by a guide nucleotide sequence, e.g., a polynucleotide comprising a nucleotide sequence that is complementary to one of the strands of the target sequence in the CCR5 gene. Thus, by designing the guide nucleotide sequence, the nucleobase editor may be programmed to edit any specific target base in the CCR5 gene. In some embodiments, the guide nucleotide sequence is co-expressed with the nucleobase editor in a cell where editing is desired.

Codon Change

Using the nucleobase editors described herein, several amino acid codons may be converted to a different codon via deamination of a target base within the codon. For example, in some embodiments, a cytosine (C) base is converted to a thymine (T) base via deamination by a nucleobase editor comprising a cytosine deaminase domain (e.g., APOBEC1 or AID). As it is familiar to one skilled in the art, conversion of a base in an amino acid codon may lead to a change of the encoded amino acid in the protein product. Cytosine deaminases are capable of converting a cytosine (C) base to a deoxyuridine (dU) base via deamination, which is replicated as a thymine (T). Thus, it is envisioned that, for amino acid codons containing a C base, the C base may be converted to T in the CCR5 gene. For example, leucine codon (CTC) may be changed to a TTC (phenylalanine) codon via the deamination of the first C on the coding strand. For amino acid codons that contains a guanine (G) base, a C base is present on the complementary strand; and the G base may be converted to an adenosine (A) via the deamination of the C on the complementary strand. For example, a ATG (Met/M) codon may be converted to a ATA (Ile/I) codon via the deamination of the third C on the complementary strand. In some embodiments, two C to T changes are required to convert a codon to a different codon. Non-limiting examples of possible mutations that may be made in a CCR5-encoding polynucleotide by the nucleobase editors of the present disclosure in order to produce novel CCR5 variants are summarized in Table 7.

In some embodiments, to bind to its target sequence and edit the desired base, the nucleobase editor depends on its guide nucleotide sequence (e.g., a guide RNA). In some embodiments, the guide nucleotide sequence is a gRNA sequence. An gRNA typically comprises a tracrRNA framework allowing for Cas9 binding, and a guide sequence, which confers sequence specificity to fusion proteins disclosed herein. In some embodiments, the guide RNA comprises a structure 5'-[guide sequence]-guuuuagagcuagaaauagcaaguuaaaauaaaggcuaguccguuaucaacuugaaaaagu-ggcaccgagucggugcuuuuu-3' (SEQ ID NO: 330), wherein the guide sequence comprises a sequence that is complementary to the target sequence. In some embodiments, the guide RNA comprises a structure 5'-[guide sequence]-guuuuaguacucuggaaacagaaucuacuaaaacaaggcaaaaugccguguuuaucucgucaacuuguuggcgagauuuuuu-3' (SEQ ID NO: 331), wherein the guide sequence comprises a sequence that is complementary to the target sequence. The guide sequence is typically 20 nucleotides long. For example, the guide sequence may be 15-25 nucleotides long. In certain embodiments, the guide sequence may be 15-20 or 20-25 nucleotides long. In some embodiments, the guide sequence is 15, 16, 17, 18, 19, 20, 21, 22, 23, 24, or 25 nucleotides long. Such suitable guide RNA sequences typically comprise guide sequences that are complementary to a nucleic sequence within 50 nucleotides upstream or downstream of the target nucleotide to be edited. In certain embodiments, the tracerRNA sequence may be guuuuagagcuagaaauagcaaguuaaaauaaaggcuaguccguuaucaacuugaaaaaguggcaccgagucggugcuuuuu (SEQ ID NO: 330) or guuuuaguacucuggaaacagaaucuacuaaaacaaggcaaaaugccguguuuaucucgucaacuuguuggcgagauuuuuu (SEQ ID NO: 331) or may have greater than or equal to 80% homology (e.g., greater than or equal to 80%, greater than or equal to 81%, greater than or equal to 82%, greater than or equal to 83%, greater than or equal to 84%, greater than or equal to 85%, greater than or equal to 86%, greater than or equal to 87%, greater than or equal to 88%, greater than or equal to 89%, greater than or equal to 90%, greater than or equal to 91%, greater than or equal to 92%, greater than or equal to 93%, greater than or equal to 94%, greater than or equal to 95%, greater than or equal to 96%, greater than or equal to 97%, greater than or equal to 98%, or greater than or equal to 99% homology) with one of these sequences.

Guide sequences that may be used to target the nucleobase editor to its target sequence to induce specific mutations are provided in Tables 3-5 and 8-10. The mutations and guide sequences presented herein are for illustration purpose only and are not meant to be limiting.

In some embodiments, cellular CCR5 activity may be reduced by reducing the level of properly folded, active CCR5 protein displayed on the surface of cells. Introducing destabilizing mutations into the wild type CCR5 protein may cause misfolding or deactivation of the protein, lack of maturation or glycosylation, or enhanced recycling by the vesicular system. A CCR5 variant comprising one or more destabilizing mutations described herein may have reduced levels or activity compared to the wild type CCR5 protein (e.g., the CCR5 variant may not be folded correctly, may not be transported to the membrane, may demonstrate reduced binding to a ligand including RANTES, MIP-1β, or MIP-1α, may demonstrate reduced transduction of signals through the G-proteins, or may have a reduced interaction with HIV). For example, the levels or activity of a CCR5 variant comprising one or more destabilizing mutations described herein may be reduced by at least about 20%, at least about 30%, at least about 40%, at least about 50%, at least about 60%, at least about 70%, at least about 80%, at least about 90%, at least about 95%, at least about 99%, or more.

The present disclosure further provides mutations that cause misfolding of CCR5 protein or structural destabilization of the CCR5 protein. Non-limiting, exemplary destabilizing CCR5 mutations that may be made using the methods described herein are shown in Table 1.

In some embodiments, CCR5 variants comprising more than one mutation described herein are contemplated. For example, a CCR5 variant may be produced using the methods described herein that include 1, 2, 3, 4, 5, 6, 7, 8, 9, 10, or more mutations selected from Tables 1-10. To make multiple mutations in the CCR5 gene, a plurality of guide nucleotide sequences may be used, each guide nucleotide sequence targeting one specific base. The nucleobase editor is capable of editing the base dictated by the guide nucleotide sequence. For example, 1, 2, 3, 4, 5, 6, 7, 8, 9, 10, or more guide nucleotide sequences may be used in a gene editing process. In some embodiments, the guide nucleotide sequences are RNAs (e.g., gRNA). In some embodiments, the guide nucleotide sequences are single stranded DNA molecules.

Premature Stop Codons

Some aspects of the present disclosure provide strategies of editing CCR5 gene to reduce the amount of full-length, functional CCR5 protein being produced. In some embodiments, stop codons may be introduced into the coding sequence of CCR5 gene upstream of the normal stop codon (referred to as a "premature stop codon"). Premature stop codons cause premature translation termination, in turn resulting in truncated and non-functional proteins and induces rapid degradation of the mRNA via the non-sense mediated mRNA decay pathway. See, e.g., Baker et al., *Current Opinion in Cell Biology* 16 (3): 293-299, 2004; Chang et al., *Annual Review of Biochemistry* 76: 51-74, 2007; and Behm-Ansmant et al., Genes & Development 20 (4): 391-398, 2006, each of which is incorporated herein by reference.

The nucleobase editors described herein may be used to convert certain amino acid codons to a stop codon (e.g., TAA, TAG, or TGA). For example, nucleobase editors including a cytosine deaminase domain are capable of converting a cytosine (C) base to a thymine (T) base via deamination. Thus, it is envisioned that, for amino acid codons containing a C base, the C base may be converted to T. For example, a CAG (Gln/Q) codon may be changed to a TAG (amber) codon via the deamination of the first C on the coding strand. For sense codons that contain a guanine (G) base, a C base is present on the complementary strand; and the G base may be converted to an adenosine (A) via the deamination of the C on the complementary strand. For example, a TGG (Trp/W) codon may be converted to a TAG (amber) codon via the deamination of the second C on the complementary strand. In some embodiments, two C to T changes are required to convert a codon to a nonsense codon. For example, a CGG (R) codon is converted to a TAG (amber) codon via the deamination of the first C on the coding strand and the deamination of the second C on the complementary strand. Non-limiting examples of the codon changes contemplated herein are provided in Tables 5, 6, and 10.

Accordingly, the present disclosure provides non-limiting examples of amino acid codons that may be converted to premature stop codons in the CCR5 gene. In some embodiments, the introduction of stop codons may be efficacious in generating truncations when the target residue is located in a flexible loop. In some embodiments, two codons adjacent to each other may both be converted to stop codons by the action of the cytidine deaminase, resulting in two stop codons adjacent to each other (also referred to as "tandem stop codons"). "Adjacent" means there are no more than 5 amino acids between the two stop codons. For example, the two stop codons may be immediately adjacent to each other (0 amino acids in between) or have 1, 2, 3, 4, or 5 amino acids in between. The introduction of tandem stop codons may be especially efficacious in generating truncation and non-functional CCR5 variants. As a non-limiting example, the tandem stop codons may be: Q186X/Q188X, Q277X/Q288X, Q328X/Q329X, Q329X/R334X, or R341X/Q346X.

Target Base in Non-Coding Region of CCR5 Gene Splicing Variants

Some aspects of the present disclosure provide strategies of reducing cellular CCR5 activity via preventing CCR5 mRNA maturation and production. In some embodiments, such strategies involve alterations of splicing sites in the CCR5 gene. Altered splicing site may lead to altered splicing and maturation of the CCR5 mRNA. For example, in some embodiments, an altered splicing site may lead to the skipping of an exon, in turn leading to a truncated protein product or an altered reading frame. In some embodiments, an altered splicing site may lead to translation of an intron sequence and premature translation termination when an inframe stop codon is encountered by the translating ribosome in the intron. In some embodiments, a start codon is edited and protein translation initiates at the next ATG codon, which may not be in the correct coding frame.

The splicing site typically comprises an intron donor site, a Lariat branch point, and an intron acceptor site. The mechanisms of splicing are familiar to those skilled in the art. As illustrated in Table 2, the intron donor site may have a consensus sequence of GGGTRAGT, and the C bases paired with the G bases in the intron donor site consensus sequence may be targeted by a nucleobase editor described herein, thereby altering the intron donor site. The Lariat branch point also has consensus sequences, e.g., TTGTA. The C base paired with the G base in the Lariat branch point consensus sequence may be targeted by a nucleobase editor described herein, leading to the skipping of the following exon. The intron acceptor site has a consensus sequence of YACAGG, wherein Y is a pyrimidine. The C base of the consensus sequence of the intron acceptor site, and the C base paired with the G bases in the consensus sequence of the intron acceptor site may be targeted by a nucleobase editor described herein, thereby altering the intron acceptor site, in turn leading to the skipping of an exon. General strategies of altering intron-exon junctions and the start site to produce a non-functional CCR5 protein, mimicking the HIV protective effect of the CCR5-Δ32 allele are described in Table 2.

In some embodiments, a splicing site in the CCR5-coding sequence (e.g., the CCR5 gene in the genome) is altered by a programmable nuclease. The use of a programmable nuclease (e.g., TALE, ZFN, WT Cas9, or dCas9-FokI fusion protein) in generating indels in a target sequence has been described in the art, e.g., in Maeder, et al., *Mol. Cell* 31 (2): 294-301, 2008; Carroll et al., *Genetics Society of America*, 188 (4): 773-782, 2011; Miller et al., *Nature Biotechnology* 25 (7): 778-785, 2007; Christian et al., *Genetics* 186 (2): 757-61, 2008; Li et al., Nucleic Acids Res 39 (1): 359-372, 2010; and Moscou et al., *Science* 326 (5959): 1501, 2009, Guilinger et al., *Nature Biotechnology* 2014, 32 (6), 577-82, PCT Application Publication WO 2015/089427, US Patent Application Publication US 2016-0153003, and US 2015-0291965, the each of which is incorporated herein by reference.

An "indel" refers to bases inserted or deleted in the DNA of an organism, e.g., the genomic DNA of an organism. An indel may be generated via a non-homologous end joining (NHEJ) pathway following a double-strand DNA break, e.g., by cleavage of a nuclease. During NHEJ, break ends are directly ligated without the need for a homologous template, in contrast to homology directed repair, and is thus prone to generating indels. An indel that occurs in the coding sequence of a gene, will lead to frameshift mutations if the indel is an insertion or a deletion of one or two bases. An indel that occurs in the noncoding sequence of a gene, e.g., the splicing site, may cause skipping of exons or translation of intron sequences, in turn leading to frameshifting mutations and/or premature translation termination. Thus, provided in Tables 1 and 8 are non-limiting examples of splicing sites that may be targeted via programmable nucleases, e.g., WT Cas9 or dCas9-FokI fusion protein, and the guide sequences that may be used for each target site.

CCR2 Variants

Certain mutations in the C—C chemokine receptor type 2 (CCR2) have also been shown to protect against HIV infection. Thus, some aspects of the present disclosure provide the generation of loss-of-function variants of CCR2 (e.g., A335V and V64I) using the nucleobase editors and strategies described herein. Non-limiting examples of such variants and the guide sequence that may be used to make them are provided in Table 1.

```
Wild type CCR2 Gene (>gi|183979979|ref|NM_
001123041.2| Homo sapiens C-C motif chemokine
receptor 2 (CCR2), transcript variant A, mRNA, SEQ
ID NO: 332)
TTTATTCTCTGGAACATGAAACATTCTGTTGTGCTCATATCATGCAAATT

ATCACTAGTAGGAGAGCAGAGAGTGGAAATGTTCCAGGTATAAAGACCCA

CAAGATAAAGAAGCTCAGAGTCGTTAGAAACAGGAGCAGATGTACAGGGT

TTGCCTGACTCACACTCAAGGTTGCATAAGCAAGATTTCAAAATTAATCC

TATTCTGGAGACCTCAACCCAATGTACAATGTTCCTGACTGGAAAAGAAG

AACTATATTTTTCTGATTTTTTTTTCAAATCTTTACCATTAGTTGCCCT

GTATCTCCGCCTTCACTTTCTGCAGGAAACTTTATTTCCTACTTCTGCAT

GCCAAGTTTCTACCTCTAGATCTGTTTGGTTCAGTTGCTGAGAAGCCTGA

CATACCAGGACTGCCTGAGACAAGCCACAAGCTGAACAGAGAAAGTGGAT

TGAACAAGGACGCATTTCCCCAGTACATCCACAACATGCTGTCCACATCT

CGTTCTCGGTTTATCAGAAATACCAACGAGAGCGGTGAAGAAGTCACCAC
```

-continued
```
CTTTTTTGATTATGATTACGGTGCTCCCTGTCATAAATTTGACGTGAAGC

AAATTGGGGCCCAACTCCTGCCTCCGCTCTACTCGCTGGTGTTCATCTTT

GGTTTTGTGGGCAACATGCTGGTCGTCCTCATCTTAATAAACTGCAAAAA

GCTGAAGTGCTTGACTGACATTTACCTGCTCAACCTGGCCATCTCTGATC

TGCTTTTTCTTATTACTCTCCCATTGTGGGCTCACTCTGCTGCAAATGAG

TGGGTCTTTGGGAATGCAATGTGCAAATTATTCACAGGGCTGTATCACAT

CGGTTATTTTGGCGGAATCTTCTTCATCATCCTCCTGACAATCGATAGAT

ACCTGGCTATTGTCCATGCTGTGTTTGCTTTAAAAGCCAGGACGGTCACC

TTTGGGGTGGTGACAAGTGTGATCACCTGGTTGGTGGCTGTGTTTGCTTC

TGTCCCAGGAATCATCTTTACTAAATGCCAGAAAGAAGATTCTGTTTATG

TCTGTGGCCCTTATTTTCCACGAGGATGGAATAATTTCCACACAATAATG

AGGAACATTTTGGGGCTGGTCCTGCCGCTGCTCATCATGGTCATCTGCTA

CTCGGGAATCCTGAAAACCCTGCTTCGGTGTCGAAACGAGAAGAAGAGGC

ATAGGGCAGTGAGAGTCATCTTCACCATCATGATTGTTTACTTTCTCTTC

TGGACTCCCTATAATATTGTCATTCTCCTGAACACCTTCCAGGAATTCTT

CGGCCTGAGTAACTGTGAAAGCACCAGTCAACTGGACCAAGCCACGCAGG

TGACAGAGACTCTTGGGATGACTCACTGCTGCATCAATCCCATCATCTAT

GCCTTCGTTGGGGAGAAGTTCAGAAGCCTTTTTCACATAGCTCTTGGCTG

TAGGATTGCCCCACTCCAAAAACCAGTGTGTGGAGGTCCAGGAGTGAGAC

CAGGAAAGAATGTGAAAGTGACTACACAAGGACTCCTCGATGGTCGTGGA

AAAGGAAAGTCAATTGGCAGAGCCCCTGAAGCCAGTCTTCAGGACAAAGA

AGGAGCCTAGAGACAGAAATGACAGATCTCTGCTTTGGAAATCACACGTC

TGGCTTCACAGATGTGTGATTCACAGTGTGAATCTTGGTGTCTACGTTAC

CAGGCAGGAAGGCTGAGAGGAGAGAGACTCCAGCTGGGTTGGAAAACAGT

ATTTTCCAAACTACCTTCCAGTTCCTCATTTTTGAATACAGGCATAGAGT

TCAGACTTTTTTTAAATAGTAAAAATAAAATTAAAGCTGAAAACTGCAAC

TTGTAAATGTGGTAAAGAGTTAGTTTGAGTTACTATCATGTCAAACGTGA

AAATGCTGTATTAGTCACAGAGATAATTCTAGCTTTGAGCTTAAGAATTT

TGAGCAGGTGGTATGTTTGGGAGACTGCTGAGTCAACCCAATAGTTGTTG

ATTGGCAGGAGTTGGAAGTGTGTGATCTGTGGGCACATTAGCCTATGTGC

ATGCAGCATCTAAGTAATGATGTCGTTTGAATCACAGTATACGCTCCATC

GCTGTCATCTCAGCTGGATCTCCATTCTCTCAGGCTTGCTGCCAAAAGCC

TTTTGTGTTTTGTTTTGTATCATTATGAAGTCATGCGTTTAATCACATTC

GAGTGTTTCAGTGCTTCGCAGATGTCCTTGATGCTCATATTGTTCCCTAT

TTTGCCAGTGGGAACTCCTAAATCAAGTTGGCTTCTAATCAAAGCTTTTA

AACCCTATTGGTAAAGAATGGAAGGTGGAGAAGCTCCCTGAAGTAAGCAA

AGACTTTCCTCTTAGTCGAGCCAAGTTAAGAATGTTCTTATGTTGCCCAG

TGTGTTTCTGATCTGATGCAAGCAAGAAACACTGGGCTTCTAGAACCAGG

CAACTTGGGAACTAGACTCCCAAGCTGGACTATGGCTCTACTTTCAGGCC

ACATGGCTAAAGAAGGTTTCAGAAAGAAGTGGGGACAGAGCAGAACTTTC

ACCTTCATATATTTGTATGATCCTAATGAATGCATAAAATGTTAAGTTGA
```

-continued

Wild type CCR2 Gene, transcript variant B (>gi|
183979981|ref|NM_001123396.1| Homo sapiens C-C
motif chemokine receptor 2 (CCR2), transcript
variant B, mRNA, SEQ ID NO: 333)
TTTATTCTCTGGAACATGAAACATTCTGTTGTGCTCATATCATGCAAATT

ATCACTAGTAGGAGAGCAGAGAGTGGAAATGTTCCAGGTATAAAGACCCA

CAAGATAAAGAAGCTCAGAGTCGTTAGAAACAGGAGCAGATGTACAGGGT

TTGCCTGACTCACACTCAAGGTTGCATAAGCAAGATTTCAAAATTAATCC

TATTCTGGAGACCTCAACCCAATGTACAATGTTCCTGACTGGAAAAGAAG

AACTATATTTTTCTGATTTTTTTTTTCAAATCTTTACCATTAGTTGCCCT

GTATCTCCGCCTTCACTTTCTGCAGGAAACTTTATTTCCTACTTCTGCAT

GCCAAGTTTCTACCTCTAGATCTGTTTGGTTCAGTTGCTGAGAAGCCTGA

CATACCAGGACTGCCTGAGACAAGCCACAAGCTGAACAGAGAAAGTGGAT

TGAACAAGGACGCATTTCCCCAGTACATCCACAACATGCTGTCCACATCT

CGTTCTCGGTTTATCAGAAATACCAACGAGAGCGGTGAAGAAGTCACCAC

CTTTTTTGATTATGATTACGGTGCTCCCTGTCATAAATTTGACGTGAAGC

AAATTGGGGCCCAACTCCTGCCTCCGCTCTACTCGCTGGTGTTCATCTTT

GGTTTTGTGGGCAACATGCTGGTCGTCCTCATCTTAATAAACTGCAAAAA

GCTGAAGTGCTTGACTGACATTTACCTGCTCAACCTGGCCATCTCTGATC

TGCTTTTTCTTATTACTCTCCCATTGTGGGCTCACTCTGCTGCAAATGAG

TGGGTCTTTGGGAATGCAATGTGCAAATTATTCACAGGGCTGTATCACAT

CGGTTATTTTGGCGGAATCTTCTTCATCATCCTCCTGACAATCGATAGAT

ACCTGGCTATTGTCCATGCTGTGTTTGCTTTAAAAGCCAGGACGGTCACC

TTTGGGGTGGTGACAAGTGTGATCACCTGGTTGGTGGCTGTGTTTGCTTC

TGTCCCAGGAATCATCTTTACTAAATGCCAGAAAGAAGATTCTGTTTATG

TCTGTGGCCCTTATTTTCCACGAGGATGGAATAATTTCCACACAATAATG

AGGAACATTTTGGGGCTGGTCCTGCCGCTGCTCATCATGGTCATCTGCTA

CTCGGGAATCCTGAAAACCCTGCTTCGGTGTCGAAACGAGAAGAAGAGGC

ATAGGGCAGTGAGAGTCATCTTCACCATCATGATTGTTTACTTTCTCTTC

TGGACTCCCTATAATATTGTCATTCTCCTGAACACCTTCCAGGAATTCTT

CGGCCTGAGTAACTGTGAAAGCACCAGTCAACTGGACCAAGCCACGCAGG

TGACAGAGACTCTTGGGATGACTCACTGCTGCATCAATCCCATCATCTAT

GCCTTCGTTGGGGAAGTTCAGAAGGTATCTCTCGGTGTTCTTCCGAAA

GCACATCACCAAGCGCTTCTGCAAACAATGTCCAGTTTTCTACAGGGAGA

CAGTGGATGGAGTGACTTCAACAAACACGCCTTCCACTGGGGAGCAGGAA

GTCTCGGCTGGTTTATAAAACGAGGAGCAGTTTGATTGTTGTTTATAAAG

GGAGATAACAATCTGTATATAACAACAAACTTCAAGGGGTTTGTTGAACAA

TAGAAACCTGTAAAGCAGGTGCCCAGGAACCTCAGGGCTGTGTGTACTAA

TACAGACTATGTCACCCAATGCATATCCAACATGTGCTCAGGGAATAATC

CAGAAAAACTGTGGGTAGAGACTTTGACTCTCCAGAAAGCTCATCTCAGC

TCCTGAAAAATGCCTCATTACCTTGTGCTAATCCTCTTTTTCTAGTCTTC

ATAATTTCTTCACTCAATCTCTGATTCTGTCAATGTCTTGAAATCAAGGG

CCAGCTGGAGGTGAAGAAGAGAATGTGACAGGCACAGATGAATGGGAGTG

AGGGATAGTGGGGTCAGGGCTGAGAGGAGAAGGAGGGAGACATGAGCATG

GCTGAGCCTGGACAAAGACAAAGGTGAGCAAAGGGCTCACGCATTCAGCC

AGGAGATGATACTGGTCCTTAGCCCCATCTGCCACGTGTATTTAACCTTG

AAGGGTTCACCAGGTCAGGGAGAGTTTGGGAACTGCAATAACCTGGGAGT

TTTGGTGGAGTCCGATGATTCTCTTTTGCATAAGTGCATGACATATTTTT

GCTTTATTACAGTTTATCTATGGCACCCATGCACCTTACATTTGAAATCT

ATGAAATATCATGCTCCATTGTTCAGATGCTTCTTAGGCCACATCCCCCT

GTCTAAAAATTCAGAAAATTTTTGTTTATAAAGA

Human CCR2 isoform A, Amino Acid Sequence (>gi|
183979980|ref|NP_001116513.2|C-C chemokine
receptor type 2 isoform A [Homo sapiens], SEQ
ID NO: 334)
MLSTSRSRFIRNTNESGEEVTTFFDYDYGAPCHKFDVKQIGAQLLPPLYS

LVFIFGFVGNMLVVLILINCKKLKCLTDIYLLNLAISDLLFLITLPLWAH

SAANEWVFGNAMCKLFTGLYHIGYFGGIFFIILLTIDRYLAIVHAVFALK

ARTVTFGVVTSVITWLVAVFASVPGIIFTKCQKEDSVYVCGPYFPRGWNN

FHTIMRNILGLVLPLLIMVICYSGILKTLLRCRNEKKRHRAVRVIFTIMI

VYFLFWTPYNIVILLNTFQEFFGLSNCESTSQLDQATQVTETLGMTHCCI

NPIIYAFVGEKFRSLFHIALGCRIAPLQKPVCGGPGVRPGKNVKVTTQGL

LDGRGKGKSIGRAPEASLQDKEGA

Human CCR2 isoform B, Amino Acid Sequence (>gi|
183979982|ref|NP_001116868.1|C-C chemokine
receptor type 2 isoform B [Homo sapiens], SEQ ID
NO: 335)
MLSTSRSRFIRNTNESGEEVTTFFDYDYGAPCHKFDVKQIGAQLLPPLYS

LVFIFGFVGNMLVVLILINCKKLKCLTDIYLLNLAISDLLFLITLPLWAH

SAANEWVFGNAMCKLFTGLYHIGYFGGIFFIILLTIDRYLAIVHAVFALK

ARTVTFGVVTSVITWLVAVFASVPGIIFTKCQKEDSVYVCGPYFPRGWNN

FHTIMRNILGLVLPLLIMVICYSGILKTLLRCRNEKKRHRAVRVIFTIMI

VYFLFWTPYNIVILLNTFQEFFGLSNCESTSQLDQATQVTETLGMTHCCI

NPIIYAFVGEKFRRYLSVFFRKHITKRFCKQCPVFYRETVDGVTSTNTPS

TGEQEVSAGL

Mouse CCR2 Amino Acid Sequence (>gi|6753466|ref|
NP_034045.1|C-C chemokine receptor type 2 [Mus
musculus], SEQ ID NO: 336)
MEDNNMLPQFIHGILSTSHSLFTRSIQELDEGATTPYDYDDGEPCHKTSV

KQIGAWILPPLYSLVFIFGFVGNMLVIIILIGCKKLKSMTDIYLLNLAIS

DLLFLLTLPFWAHYAANEWVFGNIMCKVFTGLYHIGYFGGIFFIILLTID

RYLAIVHAVFALKARTVTFGVITSVVTWVVAVFASLPGIIFTKSKQDDHH

YTCGPYFTQLWKNFQTIMRNILSLILPLLVMVICYSGILHTLFRCRNEKK

RHRAVRLIFAIMIVYFLFWTPYNIVLFLTTFQESLGMSNCVIDKHLDQAM

QVTETLGMTHCCINPVIYAFVGEKFRRYLSIFFRKHIAKRLCKQCPVFYR

ETADRVSSTFTPSTGEQEVSVGL

Rat CCR2 Amino Acid Sequence (>gi|11177914|ref|
NP_068638.1|C-C chemokine receptor type 2 [Rattus
norvegicus], SEQ ID NO: 337)
MEDSNMLPQFIHGILSTSHSLFPRSIQELDEGATTPYDYDDGEPCHKTSV

KQIGAWILPPLYSLVFIFGFVGNMLVIIILISCKKLKSMTDIYLFNLAIS

DLLFLLTLPFWAHYAANEWVFGNIMCKLFTGLYHIGYFGGIFFIILLTID

RYLAIVHAVFALKARTVTFGVITSVVTWVVAVFASLPGIIFTKSEQEDDQ

HTCGPYFPTIWKNFQTIMRNILSLILPLLVMVICYSGILHTLFRCRNEKK

RHRAVRLIFAIMIVYFLFWTPYNIVLFLTTFQEFLGMSNCVVDMHLDQAM

QVTETLGMTHCCVNPIIYAFVGEKFRRYLSIFFRKHIAKNLCKQCPVFYR

ETADRVSSTFTPSTGEQEVSVGL

In some embodiments, simultaneous introduction of loss-of-function mutations into more than one protein factor affecting HIV infection are provided. For example, in some embodiments, a loss-of-function mutation may be simultaneously introduced into CCR5 and CCR2. In some embodiments to simultaneously introduce loss-of-function mutations into more than one protein, multiple guide nucleotide sequences are used. In some embodiments a guide nucleotide matching both gene sequences is used to simultaneously introduce loss-of-function mutations into more than one protein. In some embodiments a guide nucleotide partially matching one or both of the gene sequences is used to simultaneously introduce loss-of-function mutations into more than one protein, wherein one to four mismatches are allowed between the guide RNA and a target sequence.

Further provided herein are the generation of novel and uncharacterized mutations in any of the protein factors involved in HIV infection. For example, libraries of guide nucleotide sequences may be designed for all possible PAM sequences in the genomic site of these protein factors, and used to generate mutations in these proteins. The function of the protein variants may be evaluated. If a loss-of-function variant is identified, the specific gRNA used for making the mutation may be identified via sequencing of the edited genomic site, e.g., via DNA deep sequencing.

Nucleobase Editors

The methods of generating loss-of-function CCR5 variants described herein are enabled by the use of the nucleobase editors. As described herein, a nucleobase editor is a fusion protein comprising: (i) a programmable DNA binding protein domain; and (ii) a deaminase domain. It is to be understood that any programmable DNA binding domain may be used in the base editors.

In some embodiments, the programmable DNA binding protein domain comprises the DNA binding domain of a zinc finger nuclease (ZFN) or a transcription activator-like effector domain (TALE). In some embodiments, the programmable DNA binding protein domain may be programmed by a guide nucleotide sequence and is thus referred as a "guide nucleotide sequence-programmable DNA binding-protein domain." In some embodiments, the guide nucleotide sequence-programmable DNA binding protein is a nuclease inactive Cas9, or dCas9. A dCas9, as used herein, encompasses a Cas9 that is completely inactive in its nuclease activity, or partially inactive in its nuclease activity (e.g., a Cas9 nickase). Thus, in some embodiments, the guide nucleotide sequence-programmable DNA binding protein is a Cas9 nickase. In some embodiments, the guide nucleotide sequence-programmable DNA binding protein is a nuclease inactive Cpf1. In some embodiments, the guide nucleotide sequence-programmable DNA binding protein is a nuclease inactive Argonaute.

In some embodiments, the guide nucleotide sequence-programmable DNA binding protein is a dCas9 domain. In some embodiments, the guide nucleotide sequence-programmable DNA binding protein is a Cas9 nickase. In some embodiments, the dCas9 domain comprises an amino acid sequence of SEQ ID NO: 2 or SEQ ID NO: 3. In some embodiments, the dCas9 domain comprises an amino acid sequence that is at least 60%, at least 65%, at least 70%, at least 75%, at least 80%, at least 85%, at least 90%, at least 91%, at least 92%, at least 93%, at least 94%, at least 95%, at least 96%, at least 97%, at least 98%, at least 99%, or at least 99.5% identical to any one of the Cas9 domains provided herein (e.g., SEQ ID NOs: 1-260, 270-292, 315-323, 680, or 682), and comprises mutations corresponding to D10X (X is any amino acid except for D) and/or H840X (X is any amino acid except for H) in SEQ ID NO: 1. In some embodiments, the dCas9 domain comprises an amino acid sequence that is at least 60%, at least 65%, at least 70%, at least 75%, at least 80%, at least 85%, at least 90%, at least 91%, at least 92%, at least 93%, at least 94%, at least 95%, at least 96%, at least 97%, at least 98%, at least 99%, or at least 99.5% identical to any one of the Cas9 domains provided herein (e.g., SEQ ID NOs: 1-260, 270-292, 315-323, 680, or 682), and comprises mutations corresponding to D10A and/or H840A in SEQ ID NO: 1. In some embodiments, the Cas9 nickase comprises an amino acid sequence that is at least 60%, at least 65%, at least 70%, at least 75%, at least 80%, at least 85%, at least 90%, at least 91%, at least 92%, at least 93%, at least 94%, at least 95%, at least 96%, at least 97%, at least 98%, at least 99%, or at least 99.5% identical to any one of the Cas9 domains provided herein (e.g., SEQ ID NOs: 1-260, 270-292, 315-323, 680, or 682), and comprises mutations corresponding to D10X (X is any amino acid except for D) in SEQ ID NO: 1 and a histidine at a position correspond to position 840 in SEQ ID NO: 1. In some embodiments, the Cas9 nickase comprises an amino acid sequence that is at least 60%, at least 65%, at least 70%, at least 75%, at least 80%, at least 85%, at least 90%, at least 91%, at least 92%, at least 93%, at least 94%, at least 95%, at least 96%, at least 97%, at least 98%, at least 99%, or at least 99.5% identical to any one of the Cas9 domains provided herein (e.g., SEQ ID NOs: 1-260, 270-292, 315-323, 680, or 682), and comprises mutations corresponding to D10A in SEQ ID NO: 1 and a histidine at a position correspond to position 840 in SEQ ID NO: 1. In some embodiments, variants or homologues of dCas9 or Cas9 nickase (e.g., variants of SEQ ID NO: 2 or SEQ ID NO: 3, respectively) are provided which are at least about 70% identical, at least about 80% identical, at least about 90% identical, at least about 95% identical, at least about 98% identical, at least about 99% identical, at least about 99.5% identical, or at least about 99.9% identical to SEQ ID NO: 2 or SEQ ID NO: 3, respectively, and comprises mutations corresponding to D10A and/or H840A in SEQ ID NO: 1. In some embodiments, variants of Cas9 (e.g., variants of SEQ ID NO: 2) are provided having amino acid sequences which are shorter, or longer than SEQ ID NO: 2, by about 5 amino acids, by about 10 amino acids, by about 15 amino acids, by about 20 amino acids, by about 25 amino acids, by about 30 amino acids, by about 40 amino acids, by about 50 amino acids, by about 75 amino acids, by about 100 amino acids, or more, provided that the dCas9 variants comprise mutations corresponding to D10A and/or H840A in SEQ ID NO: 1. In some embodiments, variants of Cas9 nickase (e.g., variants of SEQ ID NO: 3) are provided having amino acid sequences which are shorter, or longer than SEQ ID NO: 3, by about 5 amino acids, by about 10 amino acids, by about 15 amino acids, by about 20 amino acids, by about 25 amino acids, by about 30 amino acids, by about 40 amino acids, by about 50 amino acids, by about 75 amino acids, by about 100 amino acids, or more, provided that the dCas9 variants comprise mutations corresponding to D10A and comprises a histidine at a position corresponding to position 840 in SEQ ID NO: 1.

Additional suitable nuclease-inactive dCas9 domains will be apparent to those of skill in the art based on this disclosure and knowledge in the field, and are within the scope of this disclosure. Such additional exemplary suitable nuclease-inactive Cas9 domains include, but are not limited to, D10A/H840A, D10A/D839A/H840A, D10A/D839A/H840A/N863A mutant domains in SEQ ID NO: 1 (See, e.g., Prashant et al., *Nature Biotechnology*. 2013; 31(9): 833-838, which is incorporated herein by reference), or K603R (See, e.g., Chavez et al., *Nature Methods* 12, 326-328, 2015, which is incorporated herein by reference).

In some embodiments, the nucleobase editors described herein comprise a Cas9 domain with decreased electrostatic interactions between the Cas9 domain and a sugar-phosphate backbone of a DNA, as compared to a wild-type Cas9 domain. In some embodiments, a Cas9 domain comprises one or more mutations that decreases the association between the Cas9 domain and a sugar-phosphate backbone of a DNA. In some embodiments, the nucleobase editors described herein comprises a dCas9 (e.g., with D10A and H840A mutations in SEQ ID NO: 1) or a Cas9 nickase (e.g., with D10A mutation in SEQ ID NO: 1), wherein the dCas9 or the Cas9 nickase further comprises one or more of a N497X, a R661X, a Q695X, and/or a Q926X mutation of the amino acid sequence provided in SEQ ID NO: 1, or a corresponding mutation in any of the amino acid sequences provided in SEQ ID NOs: 11-260, wherein X is any amino acid. In some embodiments, the nucleobase editors described herein comprises a dCas9 (e.g., with D10A and H840A mutations in SEQ ID NO: 1) or a Cas9 nickase (e.g., with D10A mutation in SEQ ID NO: 1), wherein the dCas9 or the Cas9 nickase further comprises one or more of a N497A, a R661A, a Q695A, and/or a Q926A mutation of the amino acid sequence provided in SEQ ID NO: 1, or a corresponding mutation in any of the amino acid sequences provided in SEQ ID NOs: 11-260. In some embodiments, the Cas9 domain (e.g., of any of the nucleobase editors provided herein) comprises the amino acid sequence as set forth in SEQ ID NO: 338. In some embodiments, the nucleobase editor comprises the amino acid sequence as set forth in SEQ ID NO: 339.

```
Cas9 variant with decreased electrostatic inter-
actions between the Cas9 and DNA backbone
DKKYSIGLAIGTNSVGWAVITDEYKVPSKKFKVLGNTDRHSIKKNLIGAL

LFDSGETALATRLKRTARRRYTRRKNRICYLQEIFSNEMAKVDDSFFHRL

EESFLVEEDKKHERHPIFGNIVDEVAYHEKYPTIYHLRKKLVDSTDKADL

RLIYLALAHMIKFRGHFLIEGDLNPDNSDVDKLFIQLVQTYNQLFEENPI

NASGVDAKAILSARLSKSRRLENLIAQLPGEKKNGLFGNLIALSLGLTPN

FKSNFDLAEDAKLQLSKDTYDDDLDNLLAQIGDQYADLFLAAKNLSDAIL

LSDILRVNTEITKAPLSASMIKRYDEHHQDLTLLKALVRQQLPEKYKEIF

FDQSKNGYAGYIDGGASQEEFYKFIKPILEKMDGTEELLVKLNREDLLRK

QRTFDNGSIPHQIHLGELHAILRRQEDFYPFLKDNREKIEKILTFRIPYY

VGPLARGNSRFAWMTRKSEETITPWNFEEVVDKGASAQSFIERMTAFDKN

LPNEKVLPKHSLLYEYFTVYNELTKVKYVTEGMRKPAFLSGEQKKAIVDL

LFKTNRKVTVKQLKEDYFKKIECFDSVEISGVEDRFNASLGTYHDLLKII

KDKDFLDNEENEDILEDIVLTLTLFEDREMIEERLKTYAHLFDDKVMKQL

KRRRYTGWGALSRKLINGIRDKQSGKTILDFLKSDGFANRNFMALIHDDS

LTFKEDIQKAQVSGQGDSLHEHIANLAGSPAIKKGILQTVKVVDELVKVM

GRHKPENIVIEMARENQTTQKGQKNSRERMKRIEEGIKELGSQILKEHPV

ENTQLQNEKLYLYYLQNGRDMYVDQELDINRLSDYDVDHIVPQSFLKDDS

IDNKVLTRSDKNRGKSDNVPSEEVVKKMKNYWRQLLNAKLITQRKFDNLT

KAERGGLSELDKAGFIKRQLVETRAITKHVAQILDSRMNTKYDENDKLIR

EVKVITLKSKLVSDFRKDFQFYKVREINNYHHAHDAYLNAVVGTALIKKY

PKLESEFVYGDYKVYDVRKMIAKSEQEIGKATAKYFFYSNIMNFFKTEIT

LANGEIRKRPLIETNGETGEIVWDKGRDFATVRKVLSMPQVNIVKKTEVQ

TGGFSKESILPKRNSDKLIARKKDWDPKKYGGFDSPTVAYSVLVVAKVEK

GKSKKLKSVKELLGITIMERSSFEKNPIDFLEAKGYKEVKKDLIIKLPKY

SLFELENGRKRMLASAGELQKGNELALPSKYVNFLYLASHYEKLKGSPED

NEQKQLFVEQHKHYLDEIIEQISEFSKRVILADANLDKVLSAYNKHRDKP

IREQAENIIHLFTLTNLGAPAAFKYFDTTIDRKRYTSTKEVLDATLIHQS

ITGLYETRIDLSQLGGD
(SEQ ID NO: 338, mutations
relative to SEQ ID NO: 1 are bolded and underlined)

High fidelity nucleobase editor (HF-BE3)
                                  (SEQ ID NO: 339)
MSSETGPVAVDPTLRRRIEPHEFEVFFDPRELRKETCLLYEINWGGRHSI

WRHTSQNTNKHVEVNFIEKFTTERYFCPNTRCSITWFLSWSPCGECSRAI

TEFLSRYPHVTLFIYIARLYHHADPRNRQGLRDLISSGVTIQIMTEQESG

YCWRNFVNYSPSNEAHWPRYPHLWVRLYVLELYCIILGLPPCLNILRRKQ

PQLTFFTIALQSCHYQRLPPHILWATGLKSGSETPGTSESATPESDKKYS

IGLAIGTNSVGWAVITDEYKVPSKKFKVLGNTDRHSIKKNLIGALLFDSG

ETAEATRLKRTARRRYTRRKNRICYLQEIFSNEMAKVDDSFFHRLEESFL

VEEDKKHERHPIFGNIVDEVAYHEKYPTIYHLRKKLVDSTDKADLRLIYL

ALAHMIKFRGHFLIEGDLNPDNSDVDKLFIQLVQTYNQLFEENPINASGV

DAKAILSARLSKSRRLENLIAQLPGEKKNGLFGNLIALSLGLTPNFKSNF

DLAEDAKLQLSKDTYDDDLDNLLAQIGDQYADLFLAAKNLSDAILLSDIL

RVNTEITKAPLSASMIKRYDEHHQDLTLLKALVRQQLPEKYKEIFFDQSK

NGYAGYIDGGASQEEFYKFIKPILEKMDGTEELLVKLNREDLLRKQRTFD

NGSIPHQIHLGELHAILRRQEDFYPFLKDNREKIEKILTFRIPYYVGPLA

RGNSRFAWMTRKSEETITPWNFEEVVDKGASAQSFIERMTAFDKNLPNEK

VLPKHSLLYEYFTVYNELTKVKYVTEGMRKPAFLSGEQKKAIVDLLFKTN

RKVTVKQLKEDYFKKIECFDSVEISGVEDRFNASLGTYHDLLKIIKDKDF

LDNEENEDILEDIVLTLTLFEDREMIEERLKTYAHLFDDKVMKQLKRRRY
```

-continued
```
TGWGALSRKLINGIRDKQSGKTILDFLKSDGFANRNFMALIHDDSLTFKE

DIQKAQVSGQGDSLHEHIANLAGSPAIKKGILQTVKVVDELVKVMGRHKP

ENIVIEMARENQTTQKGQKNSRERMKRIEEGIKELGSQILKEHPVENTQL

QNEKLYLYYLQNGRDMYVDQELDINRLSDYDVDHIVPQSFLKDDSIDNKV

LTRSDKNRGKSDNVPSEEVVKKMKNYWRQLLNAKLITQRKFDNLTKAERG

GLSELDKAGFIKRQLVETRAITKHVAQILDSRMNTKYDENDKLIREVKVI

TLKSKLVSDFRKDFQFYKVREINNYHHAHDAYLNAVVGTALIKKYPKLES

EFVYGDYKVYDVRKMIAKSEQEIGKATAKYFFYSNIMNFFKTEITLANGE

IRKRPLIETNGETGEIVWDKGRDFATVRKVLSMPQVNIVKKTEVQTGGFS

KESILPKRNSDKLIARKKDWDPKKYGGFDSPTVAYSVLVVAKVEKGKSKK

LKSVKELLGITIMERSSFEKNPIDFLEAKGYKEVKKDLIIKLPKYSLFEL

ENGRKRMLASAGELQKGNELALPSKYVNFLYLASHYEKLKGSPEDNEQKQ

LFVEQHKHYLDEIIEQISEFSKRVILADANLDKVLSAYNKHRDKPIREQA

ENIIHLFTLTNLGAPAAFKYFDTTIDRKRYTSTKEVLDATLIHQSITGLY

ETRIDLSQLGGD
```

The Cas9 protein recognizes a short motif (PAM motif) within the target DNA sequence, which is required for the Cas9-DNA interaction but that is not determined by complementarity to the guide RNA nucleotide sequence. A "PAM motif" or "protospacer adjacent motif," as used herein, refers to a DNA sequence adjacent to the 5'- or 3'-immediately following the DNA sequence that is complementary to the guide RNA oligonucleotide sequence. Cas9 will not successfully bind to, cleave, or nick the target DNA sequence if it is not followed by an appropriate PAM sequence. Without wishing to be bound by any particular theory, specific amino acid residues in the Cas9 enzyme are responsible for interacting with the bases of the PAM and determine the PAM specificity. Therefore, changes in these residues or nearby residues leads to a different or relaxed PAM specificity. Changing or relaxing the PAM specificity may shift the places where Cas9 can bind on the CCR5 gene sequence, and it may modify the target window available to the fused cytidine deaminase, as it will be apparent to those of skill in the art based on the instant disclosure.

Wild-type *Streptococcus pyogenes* Cas9 recognizes a canonical PAM sequence (5'-NGG-3'). Other Cas9 nucleases (e.g., Cas9 from *Streptococcus thermophiles, Staphylococcus aureus, Neisseria meningitidis*, or *Treponema denticolaor*) and Cas9 variants thereof have been described in the art to have different, or more relaxed PAM requirements. For example, in Kleinstiver et al., *Nature* 523, 481-485, 2015; Klenstiver et al., *Nature* 529, 490-495, 2016; Ran et al., *Nature*, April 9; 520(7546): 186-191, 2015; Kleinstiver et al., *Nat Biotechnol*, 33(12):1293-1298, 2015; Hou et al., *Proc Natl Acad Sci US A*, 110(39):15644-9, 2014; Prykhozhij et al., *PLoS One*, 10(3): e0119372, 2015; Zetsche et al., *Cell* 163, 759-771, 2015; Gao et al., *Nature Biotechnology*, doi:10.1038/nbt.3547, 2016; Want et al., *Nature* 461, 754-761, 2009; Chavez et al., doi: dx.doi dot org/10.1101/058974; Fagerlund et al., *Genome Biol*. 2015; 16: 25, 2015; Zetsche et al., *Cell*, 163, 759-771, 2015; and Swarts et al., *Nat Struct Mol Biol*, 21(9):743-53, 2014, each of which is incorporated herein by reference.

Thus, the guide nucleotide sequence-programmable DNA-binding protein of the present disclosure may recognize a variety of PAM sequences including, without limitation PAM sequences that are on the 3' or the 5' end of the DNA sequence determined by the guide RNA. For example, the sequence may be: NGG, NGAN, NGNG, NGAG, NGCG, NNGRRT, NGRRN, NNNRRT, NNNGATT, NNAGAAW, NAAAC, TTN, TTTN, and YTN, wherein Y is a pyrimidine, R is a purine, and N is any nucleobase.

One example of an RNA-programmable DNA-binding protein that has different PAM specificity is Clustered Regularly Interspaced Short Palindromic Repeats from *Prevotella* and *Francisella* 1 (Cpf1). Similar to Cas9, Cpf1 is also a class 2 CRISPR effector. It has been shown that Cpf1 mediates robust DNA interference with features distinct from Cas9. Cpf1 is a single RNA-guided endonuclease lacking tracrRNA, and it may utilize a T-rich protospacer-adjacent motif (e.g., TTN, TTTN, or YTN), which is on the 5'-end of the DNA sequence determined by the guide RNA. Moreover, Cpf1 cleaves DNA via a staggered DNA double-stranded break. Out of 16 Cpf1-family proteins, two enzymes from *Acidaminococcus* and Lachnospiraceae are shown to have efficient genome-editing activity in human cells.

Also useful in the present compositions and methods are nuclease-inactive Cpf1 (dCpf1) variants that may be used as a guide nucleotide sequence-programmable DNA-binding protein domain. The Cpf1 protein has a RuvC-like endonuclease domain that is similar to the RuvC domain of Cas9 but does not have a HNH endonuclease domain, and the N-terminal of Cpf1 does not have the alfa-helical recognition lobe of Cas9. It was shown in Zetsche et al., *Cell*, 163, 759-771, 2015 (which is incorporated herein by reference) that, the RuvC-like domain of Cpf1 is responsible for cleaving both DNA strands and inactivation of the RuvC-like domain inactivates Cpf1 nuclease activity. For example, mutations corresponding to D917A, E1006A, or D1255A in *Francisella novicida* Cpf1 (SEQ ID NO: 340) inactivates Cpf1 nuclease activity. In some embodiments, the dCpf1 of the present disclosure may comprise mutations corresponding to D917A, E1006A, D1255A, D917A/E1006A, D917A/D1255A, E1006A/D1255A, or D917A/E1006A/D1255A in SEQ ID NO: 340. In other embodiments, the Cpf1 nickase of the present disclosure may comprise mutations corresponding to D917A, E1006A, D1255A, D917A/E1006A, D917A/D1255A, E1006A/D1255A, or D917A/E1006A/D1255A in SEQ ID NO: 340. A Cpf1 nickase useful for the embodiments of the instant disclosure may comprise other mutations and/or further mutations known in the field. It is to be understood that any mutations, e.g., substitution mutations, deletions, or insertions that fully or partially inactivates the RuvC domain of Cpf1 may be used in accordance with the present disclosure, and that these mutations of Cpf1 may result in, for example, a dCpf1 or Cpf1 nickase.

Thus, in some embodiments, the guide nucleotide sequence-programmable DNA binding protein is a nuclease inactive Cpf1 (dCpf1). In some embodiments, the dCpf1 comprises an amino acid sequence of any one SEQ ID NOs: 340-347. In some embodiments, the dCpf1 comprises an amino acid sequence that is at least 85%, at least 90%, at least 91%, at least 92%, at least 93%, at least 94%, at least 95%, at least 96%, at least 97%, at least 98%, at least 99%, or at ease 99.5% identical to any one of SEQ ID NOs: 340-347, and comprises mutations corresponding to D917A, E1006A, D1255A, D917A/E1006A, D917A/D1255A, E1006A/D1255A, or D917A/E1006A/D1255A in SEQ ID NO: 340. Cpf1 from other bacterial species may also be used in accordance with the present disclosure, as a dCpf1 or Cpf1 nickase.

Wild type *Francisella novicida* Cpf1 (D917, E1006, and D1255 are bolded and underlined)

(SEQ ID NO: 340)

MSIYQEFVNKYSLSKTLRFELIPQGKTLENIKARGLILDDEKRAKDYKKAKQIIDKYHQF

FIEEILSSVCISEDLLQNYSDVYFKLKKSDDDNLQKDFKSAKDTIKKQISEYIKDSEKFKN

LFNQNLIDAKKGQESDLILWLKQSKDNGIELFKANSDITDIDEALEIIKSFKGWTTYFKGF

HENRKNVYSSNDIPTSIIYRIVDDNLPKFLENKAKYESLKDKAPEAINYEQIKKDLAEELT

FDIDYKTSEVNQRVFSLDEVFEIANFNNYLNQSGITKFNTIIGGKFVNGENTKRKGINEYI

NLYSQQINDKTLKKYKMSVLFKQILSDTESKSFVIDKLEDDSDVVTTMQSFYEQIAAFKT

VEEKSIKETLSLLFDDLKAQKLDLSKIYFKNDKSLTDLSQQVFDDYSVIGTAVLEYITQQI

APKNLDNPSKKEQELIAKKTEKAKYLSLETIKLALEEFNKHRDIDKQCRFEEILANFAAIP

MIFDEIAQNKDNLAQISIKYQNQGKKDLLQASAEDDVKAIKDLLDQTNNLLHKLKIFHIS

QSEDKANILDKDEHFYLVFEECYFELANIVPLYNKIRNYITQKPYSDEKFKLNFENSTLA

NGWDKNKEPDNTAILFIKDDKYYLGVMNKKNNKIFDDKAIKENKGEGYKKIVYKLLPG

ANKMLPKVFFSAKSIKFYNPSEDILRIRNHSTHTKNGSPQKGYEKFEFNIEDCRKFIDFYK

QSISKHPEWKDFGFRFSDTQRYNS1DEFYREVENQGYKLTFENISESYIDSVVNQGKLYL

FQIYNKDFSAYSKGRPNLHTLYWKALFDERNLQDVVYKLNGEAELFYRKQSIPKKITHP

AKEAIANKNKDNPKKESVFEYDLIKDKRFTEDKFFFHCPITINFKSSGANKFNDEINLLLK

EKANDVHILSIDRGERHLAYYTLVDGKGNIIKQDTFNIIGNDRMKTNYHDKLAAIEKDR

DSARKDWKKINNIKEMKEGYLSQVVHEIAKLVIEYNAIVVFEDLNFGFKRGRFKVEKQV

YQKLEKMLIEKLNYLVFKDNEFDKTGGVLRAYQLTAPFETFKKMGKQTGIIYYVPAGFT

SKICPVTGFVNQLYPKYESVSKSQEFFSKFDKICYNLDKGYFEFSFDYKNFGDKAAKGK

WTIASFGSRLINFRNSDKNHNWDTREVYPTKELEKLLKDYSIEYGHGECIKAAICGESDK

KFFAKLTSVLNTILQMRNSKTGTELDYLISPVADVNGNFFDSRQAPKNMPQDADANGA

YHIGLKGLMLLGRIKNNQEGKKLNLVIKNEEYFEFVQNRNN

*Francisella novicida* Cpf1 D917A (A917, E1006, and D1255 are bolded and underlined)

(SEQ ID NO: 341)

MSIYQEFVNKYSLSKTLRFELIPQGKTLENIKARGLILDDEKRAKDYKKAKQIIDKYHQF

FIEEILSSVCISEDLLQNYSDVYFKLKKSDDDNLQKDFKSAKDTIKKQISEYIKDSEKFKN

LFNQNLIDAKKGQESDLILWLKQSKDNGIELFKANSDITDIDEALEIIKSFKGWTTYFKGF

HENRKNVYSSNDIPTSIIYRIVDDNLPKFLENKAKYESLKDKAPEAINYEQIKKDLAEELT

FDIDYKTSEVNQRVFSLDEVFEIANFNNYLNQSGITKFNTIIGGKFVNGENTKRKGINEYI

NLYSQQINDKTLKKYKMSVLFKQILSDTESKSFVIDKLEDDSDVVTTMQSFYEQIAAFKT

VEEKSIKETLSLLFDDLKAQKLDLSKIYFKNDKSLTDLSQQVFDDYSVIGTAVLEYITQQI

APKNLDNPSKKEQELIAKKTEKAKYLSLETIKLALEEFNKHRDIDKQCRFEEILANFAAIP

MIFDEIAQNKDNLAQISIKYQNQGKKDLLQASAEDDVKAIKDLLDQTNNLLHKLKIFHIS

QSEDKANILDKDEHFYLVFEECYFELANIVPLYNKIRNYITQKPYSDEKFKLNFENSTLA

NGWDKNKEPDNTAILFIKDDKYYLGVMNKKNNKIFDDKAIKENKGEGYKKIVYKLLPG

ANKMLPKVFFSAKSIKFYNPSEDILRIRNHSTHTKNGSPQKGYEKFEFNIEDCRKFIDFYK

QSISKHPEWKDFGFRFSDTQRYNS1DEFYREVENQGYKLTFENISESYIDSVVNQGKLYL

FQIYNKDFSAYSKGRPNLHTLYWKALFDERNLQDVVYKLNGEAELFYRKQSIPKKITHP

AKEAIANKNKDNPKKESVFEYDLIKDKRFTEDKFFFHCPITINFKSSGANKFNDEINLLLK

EKANDVHILSIARGERHLAYYTLVDGKGNIIKQDTFNIIGNDRMKTNYHDKLAAIEKDR

-continued

DSARKDWKKINNIKEMKEGYLSQVVHEIAKLVIEYNAIVVFEDLNFGFKRGRFKVEKQV

YQKLEKMLIEKLNYLVFKDNEFDKTGGVLRAYQLTAPFETFKKMGKQTGIIYYVPAGFT

SKICPVTGFVNQLYPKYESVSKSQEFFSKFDKICYNLDKGYFEFSFDYKNFGDKAAKGK

WTIASFGSRLINFRNSDKNHNWDTREVYPTKELEKLLKDYSIEYGHGECIKAAICGESDK

KFFAKLTSVLNTILQMRNSKTGTELDYLISPVADVNGNFFDSRQAPKNMPQDADANGA

YHIGLKGLMLLGRIKNNQEGKKLNLVIKNEEYFEFVQNRNN

*Francisella novicida* Cpf1 E1006A (D917, A1006, and D1255 are bolded and underlined)

(SEQ ID NO: 342)

MSIYQEFVNKYSLSKTLRFELIPQGKTLENIKARGLILDDEKRAKDYKKAKQIIDKYHQF

FIEEILSSVCISEDLLQNYSDVYFKLKKSDDDNLQKDFKSAKDTIKKQISEYIKDSEKFKN

LFNQNLIDAKKGQESDLILWLKQSKDNGIELFKANSDITDIDEALEIIKSFKGWTTYFKGF

HENRKNVYSSNDIPTSIIYRIVDDNLPKFLENKAKYESLKDKAPEAINYEQIKKDLAEELT

FDIDYKTSEVNQRVFSLDEVFEIANFNNYLNQSGITKFNTIIGGKFVNGENTKRKGINEYI

NLYSQQINDKTLKKYKMSVLFKQILSDTESKSFVIDKLEDDSDVVTTMQSFYEQIAAFKT

VEEKSIKETLSLLFDDLKAQKLDLSKIYFKNDKSLTDLSQQVFDDYSVIGTAVLEYITQQI

APKNLDNPSKKEQELIAKKTEKAKYLSLETIKLALEEFNKHRDIDKQCRFEEILANFAAIP

MIFDEIAQNKDNLAQISIKYQNQGKKDLLQASAEDDVKAIKDLLDQTNNLLHKLKIFHIS

QSEDKANILDKDEHFYLVFEECYFELANIVPLYNKIRNYITQKPYSDEKFKLNFENSTLA

NGWDKNKEPDNTAILFIKDDKYYLGVMNKKNNKIFDDKAIKENKGEGYKKIVYKLLPG

ANKMLPKVFFSAKSIKFYNPSEDILRIRNHSTHTKNGSPQKGYEKFEFNIEDCRKFIDFYK

QSISKHPEWKDFGFRFSDTQRYNSlDEFYREVENQGYKLTFENISESYIDSVVNQGKLYL

FQIYNKDFSAYSKGRPNLHTLYWKALFDERNLQDVVYKLNGEAELFYRKQSIPKKITHP

AKEAIANKNKDNPKKESVFEYDLIKDKRFTEDKFFFHCPITINFKSSGANKFNDEINLLLK

EKANDVHILSIDRGERHLAYYTLVDGKGNIIKQDTFNIIGNDRMKTNYHDKLAAIEKDR

DSARKDWKKINNIKEMKEGYLSQVVHEIAKLVIEYNAIVVFADLNFGFKRGRFKVEKQV

YQKLEKMLIEKLNYLVFKDNEFDKTGGVLRAYQLTAPFETFKKMGKQTGIIYYVPAGFT

SKICPVTGFVNQLYPKYESVSKSQEFFSKFDKICYNLDKGYFEFSFDYKNFGDKAAKGK

WTIASFGSRLINFRNSDKNHNWDTREVYPTKELEKLLKDYSIEYGHGECIKAAICGESDK

KFFAKLTSVLNTILQMRNSKTGTELDYLISPVADVNGNFFDSRQAPKNMPQDADANGA

YHIGLKGLMLLGRIKNNQEGKKLNLVIKNEEYFEFVQNRNN

*Francisella novicida* Cpf1 D1255A (D917, E1006, and A1255 are bolded and underlined)

(SEQ ID NO: 343)

MSIYQEFVNKYSLSKTLRFELIPQGKTLENIKARGLILDDEKRAKDYKKAKQIIDKYHQF

FIEEILSSVCISEDLLQNYSDVYFKLKKSDDDNLQKDFKSAKDTIKKQISEYIKDSEKFKN

LFNQNLIDAKKGQESDLILWLKQSKDNGIELFKANSDITDIDEALEIIKSFKGWTTYFKGF

HENRKNVYSSNDIPTSIIYRIVDDNLPKFLENKAKYESLKDKAPEAINYEQIKKDLAEELT

FDIDYKTSEVNQRVFSLDEVFEIANFNNYLNQSGITKFNTIIGGKFVNGENTKRKGINEYI

NLYSQQINDKTLKKYKMSVLFKQILSDTESKSFVIDKLEDDSDVVTTMQSFYEQIAAFKT

VEEKSIKETLSLLFDDLKAQKLDLSKIYFKNDKSLTDLSQQVFDDYSVIGTAVLEYITQQI

APKNLDNPSKKEQELIAKKTEKAKYLSLETIKLALEEFNKHRDIDKQCRFEEILANFAAIP

MIFDEIAQNKDNLAQISIKYQNQGKKDLLQASAEDDVKAIKDLLDQTNNLLHKLKIFHIS

-continued

QSEDKANILDKDEHFYLVFEECYFELANIVPLYNKIRNYITQKPYSDEKFKLNFENSTLA

NGWDKNKEPDNTAILFIKDDKYYLGVMNKKNNKIFDDKAIKENKGEGYKKIVYKLLPG

ANKMLPKVFFSAKSIKFYNPSEDILRIRNHSTHTKNGSPQKGYEKFEFNIEDCRKFIDFYK

QSISKHPEWKDFGFRFSDTQRYNSlDEFYREVENQGYKLTFENISESYIDSVVNQGKLYL

FQIYNKDFSAYSKGRPNLHTLYWKALFDERNLQDVVYKLNGEAELFYRKQSIPKKITHP

AKEAIANKNKDNPKKESVFEYDLIKDKRFTEDKFFFHCPITINFKSSGANKFNDEINLLLK

EKANDVHILSI<u>D</u>RGERHLAYYTLVDGKGNIIKQDTFNIIGNDRMKTNYHDKLAAIEKDR

DSARKDWKKINNIKEMKEGYLSQVVHEIAKLVIEYNAIVVF<u>E</u>DLNFGFKRGRFKVEKQV

YQKLEKMLIEKLNYLVFKDNEFDKTGGVLRAYQLTAPFETFKKMGKQTGIIYYVPAGFT

SKICPVTGFVNQLYPKYESVSKSQEFFSKFDKICYNLDKGYFEFSFDYKNFGDKAAKGK

WTIASFGSRLINFRNSDKNHNWDTREVYPTKELEKLLKDYSIEYGHGECIKAAICGESDK

KFFAKLTSVLNTILQMRNSKTGTELDYLISPVADVNGNFFDSRQAPKNMPQDA<u>A</u>ANGA

YHIGLKGLMLLGRIKNNQEGKKLNLVIKNEEYFEFVQNRNN

*Francisella novicida* Cpf1 D917A/E1006A (A917, A1006, and D1255 are bolded and underlined)

(SEQ ID NO: 344)

MSIYQEFVNKYSLSKTLRFELIPQGKTLENIKARGLILDDEKRAKDYKKAKQIIDKYHQF

FIEEILSSVCISEDLLQNYSDVYFKLKKSDDDNLQKDFKSAKDTIKKQISEYIKDSEKFKN

LFNQNLIDAKKGQESDLILWLKQSKDNGIELFKANSDITDIDEALEIIKSFKGWTTYFKGF

HENRKNVYSSNDIPTSIIYRIVDDNLPKFLENKAKYESLKDKAPEAINYEQIKKDLAEELT

FDIDYKTSEVNQRVFSLDEVFEIANFNNYLNQSGITKFNTIIGGKFVNGENTKRKGINEYI

NLYSQQINDKTLKKYKMSVLFKQILSDTESKSFVIDKLEDDSDVVTTMQSFYEQIAAFKT

VEEKSIKETLSLLFDDLKAQKLDLSKIYFKNDKSLTDLSQQVFDDYSVIGTAVLEYITQQI

APKNLDNPSKKEQELIAKKTEKAKYLSLETIKLALEEFNKHRDIDKQCRFEEILANFAAIP

MIFDEIAQNKDNLAQISIKYQNQGKKDLLQASAEDDVKAIKDLLDQTNNLLHKLKIFHIS

QSEDKANILDKDEHFYLVFEECYFELANIVPLYNKIRNYITQKPYSDEKFKLNFENSTLA

NGWDKNKEPDNTAILFIKDDKYYLGVMNKKNNKIFDDKAIKENKGEGYKKIVYKLLPG

ANKMLPKVFFSAKSIKFYNPSEDILRIRNHSTHTKNGSPQKGYEKFEFNIEDCRKFIDFYK

QSISKHPEWKDFGFRFSDTQRYNSlDEFYREVENQGYKLTFENISESYIDSVVNQGKLYL

FQIYNKDFSAYSKGRPNLHTLYWKALFDERNLQDVVYKLNGEAELFYRKQSIPKKITHP

AKEAIANKNKDNPKKESVFEYDLIKDKRFTEDKFFFHCPITINFKSSGANKFNDEINLLLK

EKANDVHILSI<u>A</u>RGERHLAYYTLVDGKGNIIKQDTFNIIGNDRMKTNYHDKLAAIEKDR

DSARKDWKKINNIKEMKEGYLSQVVHEIAKLVIEYNAIVVF<u>A</u>DLNFGFKRGRFKVEKQV

YQKLEKMLIEKLNYLVFKDNEFDKTGGVLRAYQLTAPFETFKKMGKQTGIIYYVPAGFT

SKICPVTGFVNQLYPKYESVSKSQEFFSKFDKICYNLDKGYFEFSFDYKNFGDKAAKGK

WTIASFGSRLINFRNSDKNHNWDTREVYPTKELEKLLKDYSIEYGHGECIKAAICGESDK

KFFAKLTSVLNTILQMRNSKTGTELDYLISPVADVNGNFFDSRQAPKNMPQDA<u>D</u>ANGA

YHIGLKGLMLLGRIKNNQEGKKLNLVIKNEEYFEFVQNRNN

*Francisella novicida* Cpf1 D917A/D1255A (A917, E1006, and A1255 are bolded and underlined)

(SEQ ID NO: 345)

MSIYQEFVNKYSLSKTLRFELIPQGKTLENIKARGLILDDEKRAKDYKKAKQIIDKYHQF

FIEEILSSVCISEDLLQNYSDVYFKLKKSDDDNLQKDFKSAKDTIKKQISEYIKDSEKFKN

LFNQNLIDAKKGQESDLILWLKQSKDNGIELFKANSDITDIDEALEIIKSFKGWTTYFKGF

-continued

```
HENRKNVYSSNDIPTSIIYRIVDDNLPKFLENKAKYESLKDKAPEAINYEQIKKDLAEELT

FDIDYKTSEVNQRVFSLDEVFEIANFNNYLNQSGITKFNTIIGGKFVNGENTKRKGINEYI

NLYSQQINDKTLKKYKMSVLFKQILSDTESKSFVIDKLEDDSDVVTTMQSFYEQIAAFKT

VEEKSIKETLSLLFDDLKAQKLDLSKIYFKNDKSLTDLSQQVFDDYSVIGTAVLEYITQQI

APKNLDNPSKKEQELIAKKTEKAKYLSLETIKLALEEFNKHRDIDKQCRFEEILANFAAIP

MIFDEIAQNKDNLAQISIKYQNQGKKDLLQASAEDDVKAIKDLLDQTNNLLHKLKIFHIS

QSEDKANILDKDEHFYLVFEECYFELANIVPLYNKIRNYITQKPYSDEKFKLNFENSTLA

NGWDKNKEPDNTAILFIKDDKYYLGVMNKKNNKIFDDKAIKENKGEGYKKIVYKLLPG

ANKMLPKVFFSAKSIKFYNPSEDILRIRNHSTHTKNGSPQKGYEKFEFNIEDCRKFIDFYK

QSISKHPEWKDFGFRFSDTQRYNS1DEFYREVENQGYKLTFENISESYIDSVVNQGKLYL

FQIYNKDFSAYSKGRPNLHTLYWKALFDERNLQDVVYKLNGEAELFYRKQSIPKKITHP

AKEAIANKNKDNPKKESVFEYDLIKDKRFTEDKFFFHCPITINFKSSGANKFNDEINLLLK

EKANDVHILSIARGERHLAYYTLVDGKGNIIKQDTFNIIGNDRMKTNYHDKLAAIEKDR

DSARKDWKKINNIKEMKEGYLSQVVHEIAKLVIEYNAIVVFEDLNFGFKRGRFKVEKQV

YQKLEKMLIEKLNYLVFKDNEFDKTGGVLRAYQLTAPFETFKKMGKQTGIIYYVPAGFT

SKICPVTGFVNQLYPKYESVSKSQEFFSKFDKICYNLDKGYFEFSFDYKNFGDKAAKGK

WTIASFGSRLINFRNSDKNHNWDTREVYPTKELEKLLKDYSIEYGHGECIKAAICGESDK

KFFAKLTSVLNTILQMRNSKTGTELDYLISPVADVNGNFFDSRQAPKNMPQDAAANGA

YHIGLKGLMLLGRIKNNQEGKKLNLVIKNEEYFEFVQNRNN
```

*Francisella novicida* Cpf1 E1006A/D1255A (D917, A1006, and A1255 are bolded and underlined)

(SEQ ID NO: 346)

MSIYQEFVNKYSLSKTLRFELIPQGKTLENIKARGLILDDEKRAKDYKKAKQIIDKYHQF

FIEEILSSVCISEDLLQNYSDVYFKLKKSDDDNLQKDFKSAKDTIKKQISEYIKDSEKFKN

LFNQNLIDAKKGQESDLILWLKQSKDNGIELFKANSDITDIDEALEIIKSFKGWTTYFKGF

HENRKNVYSSNDIPTSIIYRIVDDNLPKFLENKAKYESLKDKAPEAINYEQIKKDLAEELT

FDIDYKTSEVNQRVFSLDEVFEIANFNNYLNQSGITKFNTIIGGKFVNGENTKRKGINEYI

NLYSQQINDKTLKKYKMSVLFKQILSDTESKSFVIDKLEDDSDVVTTMQSFYEQIAAFKT

VEEKSIKETLSLLFDDLKAQKLDLSKIYFKNDKSLTDLSQQVFDDYSVIGTAVLEYITQQI

APKNLDNPSKKEQELIAKKTEKAKYLSLETIKLALEEFNKHRDIDKQCRFEEILANFAAIP

MIFDEIAQNKDNLAQISIKYQNQGKKDLLQASAEDDVKAIKDLLDQTNNLLHKLKIFHIS

QSEDKANILDKDEHFYLVFEECYFELANIVPLYNKIRNYITQKPYSDEKFKLNFENSTLA

NGWDKNKEPDNTAILFIKDDKYYLGVMNKKNNKIFDDKAIKENKGEGYKKIVYKLLPG

ANKMLPKVFFSAKSIKFYNPSEDILRIRNHSTHTKNGSPQKGYEKFEFNIEDCRKFIDFYK

QSISKHPEWKDFGFRFSDTQRYNSlDEFYREVENQGYKLTFENISESYIDSVVNQGKLYL

FQIYNKDFSAYSKGRPNLHTLYWKALFDERNLQDVVYKLNGEAELFYRKQSIPKKITHP

AKEAIANKNKDNPKKESVFEYDLIKDKRFTEDKFFFHCPITINFKSSGANKFNDEINLLLK

EKANDVHILSIDRGERHLAYYTLVDGKGNIIKQDTFNIIGNDRMKTNYHDKLAAIEKDR

DSARKDWKKINNIKEMKEGYLSQVVHEIAKLVIEYNAIVVFADLNFGFKRGRFKVEKQV

YQKLEKMLIEKLNYLVFKDNEFDKTGGVLRAYQLTAPFETFKKMGKQTGIIYYVPAGFT

SKICPVTGFVNQLYPKYESVSKSQEFFSKFDKICYNLDKGYFEFSFDYKNFGDKAAKGK

WTIASFGSRLINFRNSDKNHNWDTREVYPTKELEKLLKDYSIEYGHGECIKAAICGESDK

```
KFFAKLTSVLNTILQMRNSKTGTELDYLISPVADVNGNFFDSRQAPKNMPQDAAANGA

YHIGLKGLMLLGRIKNNQEGKKLNLVIKNEEYFEFVQNRNN
```

*Francisella novicida* Cpf1 D917A/E1006A/D1255A (A917, A1006, and
A1255 are bolded and underlined)
(SEQ ID NO: 347)

```
MSIYQEFVNKYSLSKTLRFELIPQGKTLENIKARGLILDDEKRAKDYKKAKQIIDKYHQF

FIEEILSSVCISEDLLQNYSDVYFKLKKSDDDNLQKDFKSAKDTIKKQISEYIKDSEKFKN

LFNQNLIDAKKGQESDLILWLKQSKDNGIELFKANSDITDIDEALEIIKSFKGWTTYFKGF

HENRKNVYSSNDIPTSIIYRIVDDNLPKFLENKAKYESLKDKAPEAINYEQIKKDLAEELT

FDIDYKTSEVNQRVFSLDEVFEIANFNNYLNQSGITKFNTIIGGKFVNGENTKRKGINEYI

NLYSQQINDKTLKKYKMSVLFKQILSDTESKSFVIDKLEDDSDVVTTMQSFYEQIAAFKT

VEEKSIKETLSLLFDDLKAQKLDLSKIYFKNDKSLTDLSQQVFDDYSVIGTAVLEYITQQI

APKNLDNPSKKEQELIAKKTEKAKYLSLETIKLALEEFNKHRDIDKQCRFEEILANFAA1P

MIFDEIAQNKDNLAQISIKYQNQGKKDLLQASAEDDVKAIKDLLDQTNNLLHKLKIFHIS

QSEDKANILDKDEHFYLVFEECYFELANIVPLYNKIRNYITQKPYSDEKFKLNFENSTLA

NGWDKNKEPDNTAILFIKDDKYYLGVMNKKNNKIFDDKAIKENKGEGYKKIVYKLLPG

ANKMLPKVFFSAKSIKFYNPSEDILRIRNHSTHTKNGSPQKGYEKFEFNIEDCRKFIDFYK

QSISKHPEWKDFGFRFSDTQRYNS1DEFYREVENQGYKLTFENISESYIDSVVNQGKLYL

FQIYNKDFSAYSKGRPNLHTLYWKALFDERNLQDVVYKLNGEAELFYRKQSIPKKITHP

AKEAIANKNKDNPKKESVFEYDLIKDKRFTEDKFFFHCPITINFKSSGANKFNDEINLLLK

EKANDVHILSIARGERHLAYYTLVDGKGNIIKQDTFNIIGNDRMKTNYHDKLAAIEKDR

DSARKDWKKINNIKEMKEGYLSQVVHEIAKLVIEYNAIVVFADLNFGFKRGRFKVEKQV

YQKLEKMLIEKLNYLVFKDNEFDKTGGVLRAYQLTAPFETFKKMGKQTGIIYYVPAGFT

SKICPVTGFVNQLYPKYESVSKSQEFFSKFDKICYNLDKGYFEFSFDYKNFGDKAAKGK

WTIASFGSRLINFRNSDKNHNWDTREVYPTKELEKLLKDYSIEYGHGECIKAAICGESDK

KFFAKLTSVLNTILQMRNSKTGTELDYLISPVADVNGNFFDSRQAPKNMPQDAAANGA

YHIGLKGLMLLGRIKNNQEGKKLNLVIKNEEYFEFVQNRNN
```

In some embodiments, the guide nucleotide sequence-programmable DNA binding protein is a Cpf1 protein from a *Acidaminococcus* species (AsCpf1). Cpf1 proteins form *Acidaminococcus* species have been described previously and would be apparent to the skilled artisan. Exemplary *Acidaminococcus* Cpf1 proteins (AsCpf1) include, without limitation, any of the AsCpf1 proteins provided herein.

Wild-type AsCpf1- Residue R912 is indicated in
bold underlining and residues 661-667 are in-
dicated in italics and underlining.
(SEQ ID NO: 684)
```
TQFEGFTNLYQVSKTLRFELIPQGKTLKHIQEQGFIEEDKARNDHYKELK

PIIDRIYKTYADQCLQLVQLDWENLSAAIDSYRKEKTEETRNALIEEQAT

YRNAIHDYFIGRTDNLTDAINKRHAEIYKGLFKAELFNGKVLKQLGTVTT

TEHENALLRSFDKFTTYFSGFYENRKNVFSAEDISTAIPHRIVQDNFPKF

KENCHIFTRLITAVPSLREHFENVKKAIGIFVSTSIEEVFSFPFYNQLLT

QTQIDLYNQLLGGISREAGTEKIKGLNEVLNLAIQKNDETAHIIASLPHR

FIPLFKQILSDRNTLSFILEEFKSDEEVIQSFCKYKTLLRNENVLETAEA

LFNELNSIDLTHIFISHKKLETISSALCDHWDTLRNALYERRISELTGKI

TKSAKEKVQRSLKHEDINLQEIISAAGKELSEAFKQKTSEILSHAHAALD

QPLPTTMLKKQEEKEILKSQLDSLLGLYHLLDWFAVDESNEVDPEFSARL

TGIKLEMEPSLSFYNKARNYATKKPYSVEKFKLNFQMPTLASGWDVNKEK

NNGAILFVKNGLYYLGIMPKQKGRYKALSFEPTEKTSEGFDKMYYDYFPD

AAKMIPKCSTQLKAVTAHFQTHTTPILLSNNFIEPLEITKEIYDLNNPEK

EPKKFQTAYA*KKTGDQK*GYREALCKWIDFTRDFLSKYTKTTSIDLSSLRP

SSQYKDLGEYYAELNPLLYHISFQRIAEKEIMDAVETGKLYLFQIYNKDF

AKGHHGKPNLHTLYWTGLFSPENLAKTSIKLNGQAELFYRPKSRMKRMAH

RLGEKMLNKKLKDQKTPIPDTLYQELYDYVNHRLSHDLSDEARALLPNVI

TKEVSHEIIKDRRFTSDKFFFHVPITLNYQAANSPSKFNQRVNAYLKEHP

ETPIIGIDRGERNLIYITVIDSTGKILEQRSLNTIQQFDYQKKLDNREKE

RVAARQAWSVVGTIKDLKQGYLSQVIHEIVDLMIHYQAVVVLENLNFGFK
```

```
SKRTGIAEKAVYQQFEKMLIDKLNCLVLKDYPAEKVGGVLNPYQLTDQFT

SFAKMGTQSGFLFYVPAPYTSKIDPLTGFVDPFVWKTIKNHESRKHFLEG

FDFLHYDVKTGDFILHFKMNRNLSFQRGLPGFMPAWDIVFEKNETQFDAK

GTPFIAGKRIVPVIENHRFTGRYRDLYPANELIALLEEKGIVFRDGSNIL

PKLLENDDSHAIDTMVALIRSVLQMRNSNAATGEDYINSPVRDLNGVCFD

SRFQNPEWPMDADANGAYHIALKGQLLLNHLKESKDLKLQNGISNQDWLA

YIQELRN
```

AsCpf1(R912A)- Residue A912 is indicated in bold underlining and residues 661-667 are indicated in italics and underlining.

(SEQ ID NO: 686)
```
TQFEGFTNLYQVSKTLRFELIPQGKTLKHIQEQGFIEEDKARNDHYKELK

PIIDRIYKTYADQCLQLVQLDWENLSAAIDSYRKEKTEETRNALIEEQAT

YRNAIHDYFIGRTDNLTDAINKRHAEIYKGLFKAELFNGKVLKQLGTVTT

TEHENALLRSFDKFTTYFSGFYENRKNVFSAEDISTAIPHRIVQDNFPKF

KENCHIFTRLITAVPSLREHFENVKKAIGIFVSTSIEEVFSFPFYNQLLT

QTQIDLYNQLLGGISREAGTEKIKGLNEVLNLAIQKNDETAHIIASLPHR

FIPLFKQILSDRNTLSFILEEFKSDEEVIQSFCKYKTLLRNENVLETAEA

LFNELNSIDLTHIFISHKKLETISSALCDHWDTLRNALYERRISELTGKI

TKSAKEKVQRSLKHEDINLQEIISAAGKELSEAFKQKTSEILSHAHAALD

QPLPTTMLKKQEEKEILKSQLDSLLGLYHLLDWFAVDESNEVDPEFSARL

TGIKLEMEPSLSFYNKARNYATKKPYSVEKFKLNFQMPTLASGWDVNKEK

NNGAILFVKNGLYYLGIMPKQKGRYKALSFEPTEKTSEGFDKMYYDYFPD

AAKMIPKCSTQLKAVTAHFQTHTTPILLSNNFIEPLEITKEIYDLNNPEK

EPKKFQTAYAKKTGDQKGYREALCKWIDFTRDFLSKYTKTTSIDLSSLRP

SSQYKDLGEYYAELNPLLYHISFQRIAEKEIMDAVETGKLYLFQIYNKDF

AKGHHGKPNLHTLYWTGLFSPENLAKTSIKLNGQAELFYRPKSRMKRMAH

RLGEKMLNKKLKDQKTPIPDTLYQELYDYVNHRLSHDLSDEARALLPNVI

TKEVSHEIIKDRRFTSDKFFFHVPITLNYQAANSPSKFNQRVNAYLKEHP

ETPIIGIDRGEANLIYITVIDSTGKILEQRSLNTIQQFDYQKKLDNREKE

RVAARQAWSVVGTIKDLKQGYLSQVIHEIVDLMIHYQAVVVLENLNFGFK

SKRTGIAEKAVYQQFEKMLIDKLNCLVLKDYPAEKVGGVLNPYQLTDQFT

SFAKMGTQSGFLFYVPAPYTSKIDPLTGFVDPFVWKTIKNHESRKHFLEG

FDFLHYDVKTGDFILHFKMNRNLSFQRGLPGFMPAWDIVFEKNETQFDAK

GTPFIAGKRIVPVIENHRFTGRYRDLYPANELIALLEEKGIVFRDGSNIL

PKLLENDDSHAIDTMVALIRSVLQMRNSNAATGEDYINSPVRDLNGVCFD

SRFQNPEWPMDADANGAYHIALKGQLLLNHLKESKDLKLQNGISNQDWLA

YIQELRN
```

In some embodiments, the guide nucleotide sequence-programmable DNA binding protein is a Cpf1 protein from a Lachnospiraceae species (LbCpf1). Cpf1 proteins form Lachnospiraceae species have been described previously have been described previously and would be apparent to the skilled artisan. Exemplary Lachnospiraceae Cpf1 proteins (LbCpf1) include, without limitation, any of the LbCpf1 proteins provided herein.

Wild-type LbCpf1 - Residues R836 and R1138 is indicated in bold underlining.
(SEQ ID NO: 685)
```
MSKLEKFTNCYSLSKTLRFKAIPVGKTQENIDNKRLLVEDEKRAEDYKGVKKLLDRYYL

SFINDVLHSIKLKNLNNYISLFRKKTRTEKENKELENLEINLRKEIAKAFKGNEGYKSLFK

KDIIETILPEFLDDKDEIALVNSFNGFTTAFTGFFDNRENMFSEEAKSTSIAFRCINENLTR

YISNMDIFEKVDAIFDKHEVQEIKEKILNSDYDVEDFFEGEFFNFVLTQEGIDVYNAIIGGF

VTESGEKIKGLNEYINLYNQKTKQKLPKFKPLYKQVLSDRESLSFYGEGYTSDEEVLEVF

RNTLNKNSEIFSSIKKLEKLFKNFDEYSSAGIFVKNGPAISTISKDIFGEWNVIRDKWNAE

YDDIHLKKKAVVTEKYEDDRRKSFKKIGSFSLEQLQEYADADLSVVEKLKEIIIQKVDEI

YKVYGSSEKLFDADFVLEKSLKKNDAVVAIMKDLLDSVKSFENYIKAFFGEGKETNRDE

SFYGDFVLAYDILLKVDHIYDAIRNYVTQKPYSKDKFKLYFQNPQFMGGWDKDKETDY

RATILRYGSKYYLAIMDKKYAKCLQKIDKDDVNGNYEKINYKLLPGPNKMLPKVFFSK

KWMAYYNPSEDIQKIYKNGTFKKGDMFNLNDCHKLIDFFKDSISRYPKWSNAYDFNFS

ETEKYKDIAGFYREVEEQGYKVSFESASKKEVDKLVEEGKLYMFQIYNKDFSDKSHGTP

NLHTMYFKLLFDENNHGQIRLSGGAELFMRRASLKKEELVVHPANSPIANKNPDNPKKT

TTLSYDVYKDKRFSEDQYELHIPIAINKCPKNIFKINTEVRVLLKHDDNPYVIGIDRGERN

LLYIVVVDGKGNIVEQYSLNEIINNFNGIRIKTDYHSLLDKKEKERFEARQNWTSIENIKE

LKAGYISQVVHKICELVEKYDAVIALEDLNSGFKNSRVKVEKQVYQKFEKMLIDKLNY

MVDKKSNPCATGGALKGYQITNKFESFKSMSTQNGFIFYIPAWLTSKIDPSTGFVNLLKT
```

-continued

KYTSIADSKKFISSFDRIMYVPEEDLFEFALDYKNFSRTDADYIKKWKLYSYGNRIRIFRN

PKKNNVFDWEEVCLTSAYKELFNKYGINYQQGDIRALLCEQSDKAFYSSFMALMSLML

QMRNSITGRTDVDFLISPVKNSDGIFYDSRNYEAQENAILPKNADANGAYNIARKVLWA

IGQFKKAEDEKLDKVKIAISNKEWLEYAQTSVKH

LbCpf1 (R836A)- Residue A836 is indicated in bold underlining.
(SEQ ID NO: 687)
MSKLEKFTNCYSLSKTLRFKAIPVGKTQENIDNKRLLVEDEKRAEDYKGVKKLLDRYYL

SFINDVLHSIKLKNLNNYISLFRKKTRTEKENKELENLEINLRKEIAKAFKGNEGYKSLFK

KDIIETILPEFLDDKDEIALVNSFNGFTTAFTGFFDNRENMFSEEAKSTSIAFRCINENLTR

YISNMDIFEKVDAIFDKHEVQEIKEKILNSDYDVEDFFEGEFFNFVLTQEGIDVYNAIIGGF

VTESGEKIKGLNEYINLYNQKTKQKLPKFKPLYKQVLSDRESLSFYGEGYTSDEEVLEVF

RNTLNKNSEIFSSIKKLEKLFKNFDEYSSAGIFVKNGPAISTISKDIFGEWNVIRDKWNAE

YDDIHLKKKAVVTEKYEDDRRKSFKKIGSFSLEQLQEYADADLSVVEKLKEIIIQKVDEI

YKVYGSSEKLFDADFVLEKSLKKNDAVVAIMKDLLDSVKSFENYIKAFFGEGKETNRDE

SFYGDFVLAYDILLKVDHIYDAIRNYVTQKPYSKDKFKLYFQNPQFMGGWDKDKETDY

RATILRYGSKYYLAIMDKKYAKCLQKIDKDDVNGNYEKINYKLLPGPNKMLPKVFFSK

KWMAYYNPSEDIQKIYKNGTFKKGDMFNLNDCHKLIDFFKDSISRYPKWSNAYDFNFS

ETEKYKDIAGFYREVEEQGYKVSFESASKKEVDKLVEEGKLYMFQIYNKDFSDKSHGTP

NLHTMYFKLLFDENNHGQIRLSGGAELFMRRASLKKEELVVHPANSPIANKNPDNPKKT

TTLSYDVYKDKRFSEDQYELHIPIAINKCPKNIFKINTEVRVLLKHDDNPYVIGIDRGEAN

LLYIVVVDGKGNIVEQYSLNEIINNFNGIRIKTDYHSLLDKKEKERFEARQNWTSIENIKE

LKAGYISQVVHKICELVEKYDAVIALEDLNSGFKNSRVKVEKQVYQKFEKMLIDKLNY

MVDKKSNPCATGGALKGYQITNKFESFKSMSTQNGFIFYIPAWLTSKIDPSTGFVNLLKT

KYTSIADSKKFISSFDRIMYVPEEDLFEFALDYKNFSRTDADYIKKWKLYSYGNRIRIFRN

PKKNNVFDWEEVCLTSAYKELFNKYGINYQQGDIRALLCEQSDKAFYSSFMALMSLML

QMRNSITGRTDVDFLISPVKNSDGIFYDSRNYEAQENAILPKNADANGAYNIARKVLWA

IGQFKKAEDEKLDKVKIAISNKEWLEYAQTSVKH

LbCpf1 (R1138A)- Residue A1138 is indicated in bold underlining.
(SEQ ID NO: 688)
MSKLEKFTNCYSLSKTLRFKAIPVGKTQENIDNKRLLVEDEKRAEDYKGVKKLLDRYYL

SFINDVLHSIKLKNLNNYISLFRKKTRTEKENKELENLEINLRKEIAKAFKGNEGYKSLFK

KDIIETILPEFLDDKDEIALVNSFNGFTTAFTGFFDNRENMFSEEAKSTSIAFRCINENLTR

YISNMDIFEKVDAIFDKHEVQEIKEKILNSDYDVEDFFEGEFFNFVLTQEGIDVYNAIIGGF

VTESGEKIKGLNEYINLYNQKTKQKLPKFKPLYKQVLSDRESLSFYGEGYTSDEEVLEVF

RNTLNKNSEIFSSIKKLEKLFKNFDEYSSAGIFVKNGPAISTISKDIFGEWNVIRDKWNAE

YDDIHLKKKAVVTEKYEDDRRKSFKKIGSFSLEQLQEYADADLSVVEKLKEIIIQKVDEI

YKVYGSSEKLFDADFVLEKSLKKNDAVVAIMKDLLDSVKSFENYIKAFFGEGKETNRDE

SFYGDFVLAYDILLKVDHIYDAIRNYVTQKPYSKDKFKLYFQNPQFMGGWDKDKETDY

RATILRYGSKYYLAIMDKKYAKCLQKIDKDDVNGNYEKINYKLLPGPNKMLPKVFFSK

KWMAYYNPSEDIQKIYKNGTFKKGDMFNLNDCHKLIDFFKDSISRYPKWSNAYDFNFS

ETEKYKDIAGFYREVEEQGYKVSFESASKKEVDKLVEEGKLYMFQIYNKDFSDKSHGTP

NLHTMYFKLLFDENNHGQIRLSGGAELFMRRASLKKEELVVHPANSPIANKNPDNPKKT

TTLSYDVYKDKRFSEDQYELHIPIAINKCPKNIFKINTEVRVLLKHDDNPYVIGIDRGERN

-continued

```
LLYIVVVDGKGNIVEQYSLNEIINNFNGIRIKTDYHSLLDKKEKERFEARQNWTSIENIKE

LKAGYISQVVHKICELVEKYDAVIALEDLNSGFKNSRVKVEKQVYQKFEKMLIDKLNY

MVDKKSNPCATGGALKGYQITNKFESFKSMSTQNGFIFYIPAWLTSKIDPSTGFVNLLKT

KYTSIADSKKFISSFDRIMYVPEEDLFEFALDYKNFSRTDADYIKKWKLYSYGNRIRIFRN

PKKNNVFDWEEVCLTSAYKELFNKYGINYQQGDIRALLCEQSDKAFYSSFMALMSLML

QMANSITGRTDVDFLISPVKNSDGIFYDSRNYEAQENAILPKNADANGAYNIARKVLWA

IGQFKKAEDEKLDKVKIAISNKEWLEYAQTSVKH
```

In some embodiments, the Cpf1 protein is a crippled Cpf1 protein. As used herein a "crippled Cpf1" protein is a Cpf1 protein having diminished nuclease activity as compared to a wild-type Cpf1 protein. In some embodiments, the crippled Cpf1 protein preferentially cuts the target strand more efficiently than the non-target strand. For example, the Cpf1 protein preferentially cuts the strand of a duplexed nucleic acid molecule in which a nucleotide to be edited resides. In some embodiments, the crippled Cpf1 protein preferentially cuts the non-target strand more efficiently than the target strand. For example, the Cpf1 protein preferentially cuts the strand of a duplexed nucleic acid molecule in which a nucleotide to be edited does not reside. In some embodiments, the crippled Cpf1 protein preferentially cuts the target strand at least 5% more efficiently than it cuts the non-target strand. In some embodiments, the crippled Cpf1 protein preferentially cuts the target strand at least 5%, at least 10%, at least 15%, at least 20%, at least 25%, at least 30%, at least 35%, at least 40%, at least 50%, at least 60%, at least 70%, at least 80%, at least 90%, or at least 100% more efficiently than it cuts the non-target strand.

In some embodiments, a crippled Cpf1 protein is a non-naturally occurring Cpf1 protein. In some embodiments, the crippled Cpf1 protein comprises one or more mutations relative to a wild-type Cpf1 protein. In some embodiments, the crippled Cpf1 protein comprises 1, 2, 3, 4, 5, 6, 7, 8, 9, 10, 11, 12, 13, 14, 15, 16, 17, 18, 19, or 20 mutations relative to a wild-type Cpf1 protein. In some embodiments, the crippled Cpf1 protein comprises an R836A mutation as set forth in SEQ ID NO: 685, or in a corresponding amino acid in another Cpf1 protein. It should be appreciated that a Cpf1 comprising a homologous residue (e.g., a corresponding amino acid) to R836A of SEQ ID NO: 685 could also be mutated to achieve similar results. In some embodiments, the crippled Cpf1 protein comprises a R1138A mutation as set forth in SEQ ID NO: 685, or in a corresponding amino acid in another Cpf1 protein. In some embodiments, the crippled Cpf1 protein comprises an R912A mutation as set forth in SEQ ID NO: 684, or in a corresponding amino acid in another Cpf1 protein. Without wishing to be bound by any particular theory, residue R838 of SEQ ID NO: 685 (LbCpf1) and residue R912 of SEQ ID NO: 684 (AsCpf1) are examples of corresponding (e.g., homologous) residues. For example, a portion of the alignment between SEQ ID NO: 684 and 685 shows that R912 and R838 are corresponding residues.

```
AcCpf1    YQAANSPSKFNQRVHAYLKEHPETPIIGIDRGERNLIYITVIDSTGKILEQRSLNTIQ--

LbCpf1    KCPKN-IFKINTEVRVLLKHDGNPVYIGIDRGERNLLYIVVVDGKGNIVEQYSLNEIINN
          *  *:* .*.. **..  :  :***********:**.*:*..*:*:** *** *
```

In some embodiments, any of the Cpf1 proteins provided herein comprises one or more amino acid deletions. In some embodiments, any of the Cpf1 proteins provided herein comprises 1, 2, 3, 4, 5, 6, 7, 8, 9, 10, 11, 12, 13, 14, 15, 16, 17, 18, 19, or 20 amino acid deletions. Without wishing to be bound by any particular theory, there is a helical region in Cpf1, which includes residues 661-667 of AsCpf1 (SEQ ID NO: 684), that may obstruct the function of a deaminase (e.g., APOBEC) that is fused to the Cpf1. This region comprises the amino acid sequence KKTGDQK (SEQ ID NO: 737). Accordingly, aspects of the disclosure provide Cpf1 proteins comprising mutations (e.g., deletions) that disrupt this helical region in Cpf1. In some embodiments, the Cpf1 protein comprises one or more deletions of the following residues in SEQ ID NO: 684, or one or more corresponding deletions in another Cpf1 protein: K661, K662, T663, G664, D665, Q666, and K667. In some embodiments, the Cpf1 protein comprises a T663 and a D665 deletion in SEQ ID NO: 684, or corresponding deletions in another Cpf1 protein. In some embodiments, the Cpf1 protein comprises a K662, T663, D665, and Q666 deletion in SEQ ID NO: 684, or corresponding deletions in another Cpf1 protein. In some embodiments, the Cpf1 protein comprises a K661, K662, T663, D665, Q666 and K667 deletion in SEQ ID NO: 684, or corresponding deletions in another Cpf1 protein.

AsCpf1 (deleted T663 and D665)
(SEQ ID NO: 689)

TQFEGFTNLYQVSKTLRFELIPQGKTLKHIQEQGFIEEDKARNDHYKELKPIIDRIYKTYA

DQCLQLVQLDWENLSAAIDSYRKEKTEETRNALIEEQATYRNAIHDYFIGRTDNLTDAIN

KRHAEIYKGLFKAELFNGKVLKQLGTVTTTEHENALLRSFDKFTTYFSGFYENRKNVFS

AEDISTAIPHRIVQDNFPKFKENCHIFTRLITAVPSLREHFENVKKAIGIFVSTSIEEVFSFPF

YNQLLTQTQIDLYNQLLGGISREAGTEKIKGLNEVLNLAIQKNDETAHIIASLPHRFIPLFK

QILSDRNTLSFILEEFKSDEEVIQSFCKYKTLLRNENVLETAEALFNELNSIDLTHIFISHKK

LETISSALCDHWDTLRNALYERRISELTGKITKSAKEKVQRSLKHEDINLQEIISAAGKEL

SEAFKQKTSEILSHAHAALDQPLPTTMLKKQEEKEILKSQLDSLLGLYHLLDWFAVDES

NEVDPEFSARLTGIKLEMEPSLSFYNKARNYATKKPYSVEKFKLNFQMPTLASGWDVN

KEKNNGAILFVKNGLYYLGIMPKQKGRYKALSFEPTEKTSEGFDKMYYDYFPDAAKMI

PKCSTQLKAVTAHFQTHTTPILLSNNFIEPLEITKEIYDLNNPEKEPKKFQTAYAKKGQKG

YREALCKWIDFTRDFLSKYTKTTSIDLSSLRPSSQYKDLGEYYAELNPLLYHISFQRIAEK

EIMDAVETGKLYLFQIYNKDFAKGHHGKPNLHTLYWTGLFSPENLAKTSIKLNGQAELF

YRPKSRMKRMAHRLGEKMLNKKLKDQKTP1PDTLYQELYDYVNHRLSHDLSDEARAL

LPNVITKEVSHEIIKDRRFTSDKFFFHVPITLNYQAANSPSKFNQRVNAYLKEHPETPIIGI

DRGERNLIYITVIDSTGKILEQRSLNTIQQFDYQKKLDNREKERVAARQAWSVVGTIKDL

KQGYLSQVIHEIVDLMIHYQAVVVLENLNFGFKSKRTGIAEKAVYQQFEKMLIDKLNCL

VLKDYPAEKVGGVLNPYQLTDQFTSFAKMGTQSGFLFYVPAPYTSKIDPLTGFVDPFVW

KTIKNHESRKHFLEGFDFLHYDVKTGDFILHFKMNRNLSFQRGLPGFMPAWDIVFEKNE

TQFDAKGTPFIAGKRIVPVIENHRFTGRYRDLYPANELIALLEEKGIVFRDGSNILPKLLEN

DDSHAIDTMVALIRSVLQMRNSNAATGEDYINSPVRDLNGVCFDSRFQNPEWPMDADA

NGAYHIALKGQLLLNHLKESKDLKLQNGISNQDWLAYIQELRN

AsCpf1 (deleted K662, T663, D665, and Q666)
(SEQ ID NO: 690)

TQFEGFTNLYQVSKTLRFELIPQGKTLKHIQEQGFIEEDKARNDHYKELKPIIDRIYKTYA

DQCLQLVQLDWENLSAAIDSYRKEKTEETRNALIEEQATYRNAIHDYFIGRTDNLTDAIN

KRHAEIYKGLFKAELFNGKVLKQLGTVTTTEHENALLRSFDKFTTYFSGFYENRKNVFS

AEDISTAIPHRIVQDNFPKFKENCHIFTRLITAVPSLREHFENVKKAIGIFVSTSIEEVFSFPF

YNQLLTQTQIDLYNQLLGGISREAGTEKIKGLNEVLNLAIQKNDETAHIIASLPHRFIPLFK

QILSDRNTLSFILEEFKSDEEVIQSFCKYKTLLRNENVLETAEALFNELNSIDLTHIFISHKK

LETISSALCDHWDTLRNALYERRISELTGKITKSAKEKVQRSLKHEDINLQEIISAAGKEL

SEAFKQKTSEILSHAHAALDQPLPTTMLKKQEEKEILKSQLDSLLGLYHLLDWFAVDES

NEVDPEFSARLTGIKLEMEPSLSFYNKARNYATKKPYSVEKFKLNFQMPTLASGWDVN

KEKNNGAILFVKNGLYYLGIMPKQKGRYKALSFEPTEKTSEGFDKMYYDYFPDAAKMI

PKCSTQLKAVTAHFQTHTTPILLSNNFIEPLEITKEIYDLNNPEKEPKKFQTAYAKGKGYR

EALCKWIDFTRDFLSKYTKTTSIDLSSLRPSSQYKDLGEYYAELNPLLYHISFQRIAEKEI

MDAVETGKLYLFQIYNKDFAKGHHGKPNLHTLYWTGLFSPENLAKTSIKLNGQAELFY

RPKSRMKRMAHRLGEKMLNKKLKDQKTPIPDTLYQELYDYVNHRLSHDLSDEARALLP

NVITKEVSHEIIKDRRFTSDKFFFHVPITLNYQAANSPSKFNQRVNAYLKEHPETPIIGIDR

GERNLIYITVIDSTGKILEQRSLNTIQQFDYQKKLDNREKERVAARQAWSVVGTIKDLKQ

GYLSQVIHEIVDLMIHYQAVVVLENLNFGFKSKRTGIAEKAVYQQFEKMLIDKLNCLVL

-continued

KDYPAEKVGGVLNPYQLTDQFTSFAKMGTQSGFLFYVPAPYTSKIDPLTGFVDPFVWKT

IKNHESRKHFLEGFDFLHYDVKTGDFILHFKMNRNLSFQRGLPGFMPAWDIVFEKNETQ

FDAKGTPFIAGKRIVPVIENHRFTGRYRDLYPANELIALLEEKGIVFRDGSNILPKLLEND

DSHAIDTMVALIRSVLQMRNSNAATGEDYINSPVRDLNGVCFDSRFQNPEWPMDADAN

GAYHIALKGQLLLNHLKESKDLKLQNGISNQDWLAYIQELRN

AsCpf1 (deleted K661, K662, T663, D665, Q666, and K667)
(SEQ ID NO: 691)
TQFEGFTNLYQVSKTLRFELIPQGKTLKHIQEQGFIEEDKARNDHYKELKPIIDRIYKTYA

DQCLQLVQLDWENLSAAIDSYRKEKTEETRNALIEEQATYRNAIHDYFIGRTDNLTDAIN

KRHAEIYKGLFKAELFNGKVLKQLGTVTTTEHENALLRSFDKFTTYFSGFYENRKNVFS

AEDISTAIPHRIVQDNFPKFKENCHIFTRLITAVPSLREHFENVKKAIGIFVSTSIEEVFSFPF

YNQLLTQTQIDLYNQLLGGISREAGTEKIKGLNEVLNLAIQKNDETAHIIASLPHRFIPLFK

QILSDRNTLSFILEEFKSDEEVIQSFCKYKTLLRNENVLETAEALFNELNSIDLTHIFISHKK

LETISSALCDHWDTLRNALYERRISELTGKITKSAKEKVQRSLKHEDINLQEIISAAGKEL

SEAFKQKTSEILSHAHAALDQPLPTTMLKKQEEKEILKSQLDSLLGLYHLLDWFAVDES

NEVDPEFSARLTGIKLEMEPSLSFYNKARNYATKKPYSVEKFKLNFQMPTLASGWDVN

KEKNNGAILFVKNGLYYLGIMPKQKGRYKALSFEPTEKTSEGFDKMYYDYFPDAAKMI

PKCSTQLKAVTAHFQTHTTPILLSNNFIEPLEITKEIYDLNNPEKEPKKFQTAYAGGYREA

LCKWIDFTRDFLSKYTKTTSIDLSSLRPSSQYKDLGEYYAELNPLLYHISFQRIAEKEIMD

AVETGKLYLFQIYNKDFAKGHHGKPNLHTLYWTGLFSPENLAKTSIKLNGQAELFYRPK

SRMKRMAHRLGEKMLNKKLKDQKTPIPDTLYQELYDYVNHRLSHDLSDEARALLPNVI

TKEVSHEIIKDRRFTSDKFFFHVPITLNYQAANSPSKFNQRVNAYLKEHPETPIIGIDRGER

NLIYITVIDSTGKILEQRSLNTIQQFDYQKKLDNREKERVAARQAWSVVGTIKDLKQGYL

SQVIHEIVDLMIHYQAVVVLENLNFGFKSKRTGIAEKAVYQQFEKMLIDKLNCLVLKDY

PAEKVGGVLNPYQLTDQFTSFAKMGTQSGFLFYVPAPYTSKIDPLTGFVDPFVWKTIKN

HESRKHFLEGFDFLHYDVKTGDFILHFKMNRNLSFQRGLPGFMPAWDIVFEKNETQFDA

KGTPFIAGKRIVPVIENHRFTGRYRDLYPANELIALLEEKGIVFRDGSNILPKLLENDDSH

AIDTMVALIRSVLQMRNSNAATGEDYINSPVRDLNGVCFDSRFQNPEWPMDADANGAY

HIALKGQLLLNHLKESKDLKLQNGISNQDWLAYIQELRN

In some embodiments, the guide nucleotide sequence-programmable DNA-binding protein domain of the present disclosure has no requirements for a PAM sequence. One example of such a guide nucleotide sequence-programmable DNA-binding protein may be an Argonaute protein from *Natronobacterium gregoryi* (NgAgo). NgAgo is a ssDNA-guided endonuclease. NgAgo binds 5' phosphorylated ssDNA of ~24 nucleotides (gDNA) to guide it to its target site and will make DNA double-strand breaks at the gDNA site. In contrast to Cas9, the NgAgo-gDNA system does not require a protospacer-adjacent motif (PAM). Using a nuclease inactive NgAgo (dNgAgo) can greatly expand the codons that may be targeted. The characterization and use of NgAgo have been described in Gao et al., *Nat Biotechnol.*, 2016 July; 34(7):768-73. PubMed PMID: 27136078; Swarts et al., *Nature.* 507(7491) (2014):258-61; and Swarts et al., *Nucleic Acids Res.* 43(10) (2015):5120-9, each of which is incorporated herein by reference. The sequence of *Natronobacterium gregoryi* Argonaute is provided in SEQ ID NO: 348.

Wild type *Natronobacterium gregoryi* Argonaute
(SEQ ID NO: 348)
MTVIDLDSTTTADELTSGHTYDISVTLTGVYDNTDEQHPRMSLAFEQDNG

ERRYITLWKNTTPKDVFTYDYATGSTYIFTNIDYEVKDGYENLTATYQTT

VENATAQEVGTTDEDETFAGGEPLDHHLDDALNETPDDAETESDSGHVMT

SFASRDQLPEWTLHTYTLTATDGAKTDTEYARRTLAYTVRQELYTDHDAA

PVATDGLMLLTPEPLGETPLDLDCGVRVEADETRTLDYTTAKDRLLAREL

VEEGLKRSLWDDYLVRGIDEVLSKEPVLTCDEFDLHERYDLSVEVGHSGR

AYLHINFRHRFVPKLTLADIDDDNIYPGLRVKTTYRPRRGHIVWGLRDEC

ATDSLNTLGNQSVVAYHRNNQTPINTDLLDAIEAADRRVVETRRQGHGDD

AVSFPQELLAVEPNTHQIKQFASDGFHQQARSKTRLSASRCSEKAQAFAE

RLDPVRLNGSTVEFSSEFFTGNNEQQLRLLYENGESVLTFRDGARGAHPD

-continued

```
ETFSKGIVNPPESFEVAVVLPEQQADTCKAQWDTMADLLNQAGAPPTRSE

TVQYDAFSSPESISLNVAGAIDPSEVDAAFVVLPPDQEGFADLASPTETY

DELKKALANMGIYSQMAYFDRFRDAKIFYTRNVALGLLAAAGGVAFTTEH

AMPGDADMFIGIDVSRSYPEDGASGQINIAATATAVYKDGTILGHSSTRP

QLGEKLQSTDVRDIMKNAILGYQQVTGESPTHIVIHRDGFMNEDLDPATE

FLNEQGVEYDIVEIRKQPQTRLLAVSDVQYDTPVKSIAAINQNEPRATVA

TFGAPEYLATRDGGGLPRPIQIERVAGETDIETLTRQVYLLSQSHIQVHN

STARLPITTAYADQASTHATKGYLVQTGAFESNVGFL
```

In some embodiments, the guide nucleotide sequence-programmable DNA-binding protein is a prokaryotic homolog of an Argonaute protein. Prokaryotic homologs of Argonaute proteins are known and have been described, for example, in Makarova K., et al., "Prokaryotic homologs of Argonaute proteins are predicted to function as key components of a novel system of defense against mobile genetic elements", Biol. Direct. 2009 Aug. 25; 4:29. doi: 10.1186/1745-6150-4-29, which is incorporated herein by reference. In some embodiments, the guide nucleotide sequence-programmable DNA-binding protein is a *Marinitoga piezophila* Argunaute (MpAgo) protein. The CRISPR-associated *Marinitoga piezophila* Argonaute (MpAgo) protein cleaves single-stranded target sequences using 5'-phosphorylated guides. The 5' guides are used by all known Argonautes. The crystal structure of an MpAgo-RNA complex shows a guide strand binding site comprising residues that block 5' phosphate interactions. This data suggests the evolution of an Argonaute subclass with noncanonical specificity for a 5'-hydroxylated guide. See, e.g., Kaya et al., "A bacterial Argonaute with noncanonical guide RNA specificity", Proc Natl Acad Sci USA. 2016 Apr. 12; 113(15):4057-62, the entire contents of which are hereby incorporated by reference). It should be appreciated that other Argonaute proteins may be used in any of the fusion proteins (e.g., base editors) described herein, for example, to guide a deaminase (e.g., cytidine deaminase) to a target nucleic acid (e.g., ssRNA).

In some embodiments, the guide nucleotide sequence-programmable DNA-binding protein is a single effector of a microbial CRISPR-Cas system. Single effectors of microbial CRISPR-Cas systems include, without limitation, Cas9, Cpf1, C2c1, C2c2, and C2c3. Typically, microbial CRISPR-Cas systems are divided into Class 1 and Class 2 systems. Class 1 systems have multisubunit effector complexes, while Class 2 systems have a single protein effector. Cas9 and Cpf1 are Class 2 effectors. In addition to Cas9 and Cpf1, three distinct Class 2 CRISPR-Cas systems (C2c1, C2c2, and C2c3) have been described by Shmakov et al., "Discovery and Functional Characterization of Diverse Class 2 CRISPR Cas Systems", Mol. Cell, 2015 Nov. 5; 60(3): 385-397, the entire contents of which are herein incorporated by reference. Effectors of two of the systems, C2c1 and C2c3, contain RuvC-like endonuclease domains related to Cpf1. A third system, C2c2 contains an effector with two predicted HEPN RNase domains. Production of mature CRISPR RNA is tracrRNA-independent, unlike production of CRISPR RNA by C2c. C2c1 depends on both CRISPR RNA and tracrRNA for DNA cleavage. Bacterial C2c2 has been shown to possess a unique RNase activity for CRISPR RNA maturation distinct from its RNA-activated single-stranded RNA degradation activity. These RNase functions are different from each other and from the CRISPR RNA-processing behavior of Cpf1. See, e.g., East-Seletsky, et al., "Two distinct RNase activities of CRISPR-C2c2 enable guide-RNA processing and RNA detection", Nature, 2016 Oct. 13; 538(7624):270-273, the entire contents of which are hereby incorporated by reference. In vitro biochemical analysis of C2c2 in *Leptotrichia shahii* has shown that C2c2 is guided by a single CRISPR RNA and can be programmed to cleave ssRNA targets carrying complementary protospacers. Catalytic residues in the two conserved HEPN domains mediate cleavage. Mutations in the catalytic residues generate catalytically inactive RNA-binding proteins. See e.g., Abudayyeh et al., "C2c2 is a single-component programmable RNA-guided RNA-targeting CRISPR effector," Science, 2016 Aug. 5; 353(6299), the entire contents of which are hereby incorporated by reference.

The crystal structure of *Alicyclobaccillus acidoterrastris* C2c1 (AacC2c1) has been reported in complex with a chimeric single-molecule guide RNA (sgRNA). See, e.g., Liu et al., "C2c1-sgRNA Complex Structure Reveals RNA-Guided DNA Cleavage Mechanism", Mol. Cell, 2017 Jan. 19; 65(2):310-322, incorporated herein by reference. The crystal structure has also been reported for *Alicyclobacillus acidoterrestris* C2c1 bound to target DNAs as ternary complexes. See, e.g., Yang et al., "PAM-dependent Target DNA Recognition and Cleavage by C2C1 CRISPR-Cas endonuclease", Cell, 2016 Dec. 15; 167(7):1814-1828, the entire contents of which are hereby incorporated by reference. Catalytically competent conformations of AacC2c1, both with target and non-target DNA strands, have been captured independently positioned within a single RuvC catalytic pocket, with C2c1-mediated cleavage resulting in a staggered seven-nucleotide break of target DNA. Structural comparisons between C2c1 ternary complexes and previously identified Cas9 and Cpf1 counterparts demonstrate the diversity of mechanisms used by CRISPR-Cas9 systems.

In some embodiments, the guide nucleotide sequence-programmable DNA-binding protein of any of the fusion proteins provided herein is a C2c1, a C2c2, or a C2c3 protein. In some embodiments, the guide nucleotide sequence-programmable DNA-binding protein is a C2c1 protein. In some embodiments, the guide nucleotide sequence-programmable DNA-binding protein is a C2c2 protein. In some embodiments, the guide nucleotide sequence-programmable DNA-binding protein is a C2c3 protein. In some embodiments, the guide nucleotide sequence-programmable DNA-binding protein comprises an amino acid sequence that is at least 85%, at least 90%, at least 91%, at least 92%, at least 93%, at least 94%, at least 95%, at least 96%, at least 97%, at least 98%, at least 99%, or at least 99.5% identical to a naturally-occurring C2c1, C2c2, or C2c3 protein. In some embodiments, the guide nucleotide sequence-programmable DNA-binding protein is a naturally-occurring C2c1, C2c2, or C2c3 protein. In some embodiments, the guide nucleotide sequence-programmable DNA-binding protein comprises an amino acid sequence that is at least 85%, at least 90%, at least 91%, at least 92%, at least 93%, at least 94%, at least 95%, at least 96%, at least 97%, at least 98%, at least 99%, or at least 99.5% identical to any one of SEQ ID NOs: 692-694. In some embodiments, the guide nucleotide sequence-programmable DNA-binding protein comprises an amino acid sequence of any one SEQ ID NOs: 692-694. It should be appreciated that C2c1, C2c2, or C2c3 from other bacterial species may also be used in accordance with the present disclosure.

C2c1 (uniprot.org/uniprot/T0D7A2#)
sp|T0D7A2|C2C1_ALIAG CRISPR-associated endonuclease C2c1 OS = *Alicyclobacillus acidoterrestris* (strain ATCC 49025/DSM 3922/CIP 106132/NCIMB 13137/GD3B) GN = c2c1 PE = 1 SV = 1

(SEQ ID NO: 692)

MAVKSIKVKLRLDDMPEIRAGLWKLHKEVNAGVRYYTEWLSLLRQENLYRRSPNGDG

EQECDKTAEECKAELLERLRARQVENGHRGPAGSDDELLQLARQLYELLVPQAIGAKG

DAQQIARKFLSPLADKDAVGGLGIAKAGNKPRWVRMREAGEPGWEEEKEKAETRKSA

DRTADVLRALADFGLKPLMRVYTDSEMSSVEWKPLRKGQAVRTWDRDMFQQAIERM

MSWESWNQRVGQEYAKLVEQKNRFEQKNFVGQEHLVHLVNQLQQDMKEASPGLESK

EQTAHYVTGRALRGSDKVFEKWGKLAPDAPFDLYDAEIKNVQRRNTRRFGSHDLFAKL

AEPEYQALWREDASFLTRYAVYNSILRKLNHAKMFATFTLPDATAHPIWTRFDKLGGN

LHQYTFLFNEFGERRHAIRFHKLLKVENGVAREVDDVTVPISMSEQLDNLLPRDPNEPIA

LYFRDYGAEQHFTGEFGGAKIQCRRDQLAHMHRRRGARDVYLNVSVRVQSQSEARGE

RRPPYAAVFRLVGDNHRAFVHFDKLSDYLAEHPDDGKLGSEGLLSGLRVMSVDLGLRT

SASISVFRVARKDELKPNSKGRVPFFFPIKGNDNLVAVHERSQLLKLPGETESKDLRAIRE

ERQRTLRQLRTQLAYLRLLVRCGSEDVGRRERSWAKLIEQPVDAANHMTPDWREAFEN

ELQKLKSLHGICSDKEWMDAVYESVRRVWRHMGKQVRDWRKDVRSGERPKIRGYAK

DVVGGNSIEQIEYLERQYKFLKSWSFFGKVSGQVIRAEKGSRFAITLREHIDHAKEDRLK

KLADRIIMEALGYVYALDERGKGKWVAKYPPCQLILLEELSEYQFNNDRPPSENNQLM

QWSHRGVFQELINQAQVHDLLVGTMYAAFSSRFDARTGAPGIRCRRVPARCTQEHNPE

PFPWWLNKFVVEHTLDACPLRADDLIPTGEGEIFVSPFSAEEGDFHQIHADLNAAQNLQ

QRLWSDFDISQIRLRCDWGEVDGELVLIPRLTGKRTADSYSNKVFYTNTGVTYYERERG

KKRRKVFAQEKLSEEEAELLVEADEAREKSVVLMRDPSGIINRGNWTRQKEFWSMVNQ

RIEGYLVKQIRSRVPLQDSACENTGDI

C2c2 (uniprot.org/uniprot/P0DOC6)
>sp|P0DOC6|C2C2_LEPSD CRISPR-associated endoribonuclease C2c2 OS = *Leptotrichia shahii* (strain DSM 19757/CCUG 47503/CIP 107916/JCM 16776/LB37) GN = c2c2 PE = 1 SV = 1

(SEQ ID NO: 693)

MGNLFGHKRWYEVRDKKDFKIKRKVKVKRNYDGNKYILNINENNNKEKIDNNKFIRKY

INYKKNDNILKEFTRKFHAGNILFKLKGKEGIIRIENNDDFLETEEVVLYIEAYGKSEKLK

ALGITKKKIIDEAIRQGITKDDKKIEIKRQENEEEIEIDIRDEYTNKTLNDCSIILRIIENDELE

TKKSIYEIFKNINMSLYKIIEKIIENETEKVFENRYYEEHLREKLLKDDKIDVILTNFMEIRE

KIKSNLEILGFVKFYLNVGGDKKKSKNKKMLVEKILNINVDLTVEDIADFVIKELEFWNI

TKRIEKVKKVNNEFLEKRRNRTYIKSYVLLDKHEKFKIERENKKDKIVKFFVENIKNNSI

KEKIEKILAEFKIDELIKKLEKELKKGNCDTEIFGIFKKHYKVNFDSKKFSKKSDEEKELY

KIIYRYLKGRIEKILVNEQKVRLKKMEKIEIEKILNESILSEKILKRVKQYTLEHIMYLGKL

RHNDIDMTTVNTDDFSRLHAKEELDLELITFFASTNMELNKIFSRENINNDENIDFFGGDR

EKNYVLDKKILNSKIKIIRDLDFIDNKNNITNNFIRKFTKIGTNERNRILHAISKERDLQGT

QDDYNKVINIIQNLKISDEEVSKALNLDVVFKDKKNIITKINDIKISEENNNDIKYLPSFSK

VLPEILNLYRNNPKNEPFDTIETEKIVLNALIYVNKELYKKLILEDDLEENESKNIFLQELK

KTLGNIDEIDENIIENYYKNAQISASKGNNKAIKKYQKKVIECYIGYLRKNYEELFDFSDF

KMNIQEIKKQIKDINDNKTYERITVKTSDKTIVINDDFEYIISIFALLNSNAVINKIRNRFFA

TSVWLNTSEYQNIIDILDEIMQLNTLRNECITENWNLNLEEFIQKMKEIEKDFDDFKIQTK

KEIFNNYYEDIKNNILTEFKDDINGCDVLEKKLEKIVIFDDETKFEIDKKSNILQDEQRKLS

```
                                                            -continued
NINKKDLKKKVDQYIKDKDQEIKSKILCRIIFNSDFLKKYKKEIDNLIEDMESENENKFQE

IYYPKERKNELYIYKKNLFLNIGNPNFDKIYGLISNDIKMADAKFLFNIDGKNIRKNKISEI

DAILKNLNDKLNGYSKEYKEKYIKKLKENDDFFAKNIQNKNYKSFEKDYNRVSEYKKIR

DLVEFNYLNKIESYLIDINWKLAIQMARFERDMHYIVNGLRELGIIKLSGYNTGISRAYPK

RNGSDGFYTTTAYYKFFDEESYKKFEKICYGFGIDLSENSEINKPENESIRNYISHFYIVRN

PFADYSIAEQIDRVSNLLSYSTRYNNSTYASVFEVFKKDVNLDYDELKKKFKLIGNNDIL

ERLMKPKKVSVLELESYNSDYIKNLIIELLTKIENTNDTL

C2c3, translated from >CEPX01008730.1 marine metagenome genome assembly
TARA_037_MES_0.1-0.22, contig TARA_037_MES 0.1-0.22 scaffold22115_1, whole
genome shotgun sequence.
                                                                   (SEQ ID NO: 694)
MRSNYHGGRNARQWRKQISGLARRTKETVFTYKFPLETDAAEIDFDKAVQTYGIAEGV

GHGSLIGLVCAFHLSGFRLFSKAGEAMAFRNRSRYPTDAFAEKLSAIMGIQLPTLSPEGL

DLIFQSPPRSRDGIAPVWSENEVRNRLYTNWTGRGPANKPDEHLLEIAGEIAKQVFPKFG

GWDDLASDPDKALAAADKYFQSQGDFPSIASLPAAIMLSPANSTVDFEGDYIAIDPAAET

LLHQAVSRCAARLGRERPDLDQNKGPFVSSLQDALVSSQNNGLSWLFGVGFQHWKEKS

PKELIDEYKVPADQHGAVTQVKSFVDAIPLNPLFDTTHYGEFRASVAGKVRSWVANYW

KRLLDLKSLLATTEFTLPESISDPKAVSLFSGLLVDPQGLKKVADSLPARLVSAEEAIDRL

MGVGIPTAADIAQVERVADEIGAFIGQVQQFNNQVKQKLENLQDADDEEFLKGLKIELP

SGDKEPPAINTRISGGAPDAAAEISELEEKLQRLLDARSEHFQTISEWAEENAVTLDPIAAM

VELERLRLAERGATGDPEEYALRLLLQRIGRLANRVSPVSAGSIRELLKPVFMEEREFNL

FFHNRLGSLYRSPYSTSRHQPFSIDVGKAKAIDWIAGLDQISSDIEKALSGAGEALGDQLR

DWINTLAGFAISQRLRGLPDTVPNALAQVRCPDDVRIPPLLAMLLEEDDIARDVCLKAFN

LYVSAINGCLFGALREGFIVRTRFQRIGTDQIHYVPKDKAWEYPDRLNTAKGPINAAVSS

DWIEKDGAVIKPVETVRNLSSTGFAGAGVSEYLVQAPHDWYTPLDLRDVAHLVTGLPV

EKNITKLKRLTNRTAFRMVGASSFKTHLDSVLLSDKIKLGDFTIIIDQHYRQSVTYGGKV

KISYEPERLQVEAAVPVVDTRDRTVPEPDTLFDHIVAIDLGERSVGFAVFDIKSCLRTGEV

KPIHDNNGNPVVGTVAVPSIRRLMKAVRSHRRRRQPNQKVNQTYSTALQNYRENVIGD

VCNRIDTLMERYNAFPVLEFQIKNFQAGAKQLEIVYGS
```

In some embodiments, the guide nucleotide sequence-programmable DNA-binding protein of any of the fusion proteins provided herein is a Cas9 from archaea (e.g. nanoarchaea), which constitute a domain and kingdom of single-celled prokaryotic microbes. In some embodiments, the guide nucleotide sequence-programmable DNA-binding protein is CasX or CasY, which have been described in, for example, Burstein et al., "New CRISPR-Cas systems from uncultivated microbes." *Cell Res.* 2017 Feb. 21. doi: 10.1038/cr.2017.21, which is incorporated herein by reference. Using genome-resolved metagenomics, a number of CRISPR-Cas systems were identified, including the first reported Cas9 in the archaeal domain of life. This divergent Cas9 protein was found in nanoarchaea as part of an active CRISPR-Cas system. In bacteria, two previously unknown systems were discovered, CRISPR-CasX and CRISPR-CasY, which are among the most compact systems yet discovered. In some embodiments, Cas9 refers to CasX, or a variant of CasX. In some embodiments, Cas9 refers to a CasY, or a variant of CasY. It should be appreciated that other RNA-guided DNA binding proteins may be used as a guide nucleotide sequence-programmable DNA-binding protein and are within the scope of this disclosure.

In some embodiments, the guide nucleotide sequence-programmable DNA-binding protein of any of the fusion proteins provided herein is a CasX or CasY protein. In some embodiments, the guide nucleotide sequence-programmable DNA-binding protein is a CasX protein. In some embodiments, the guide nucleotide sequence-programmable DNA-binding protein is a CasY protein. In some embodiments, the guide nucleotide sequence-programmable DNA-binding protein comprises an amino acid sequence that is at least 85%, at least 90%, at least 91%, at least 92%, at least 93%, at least 94%, at least 95%, at least 96%, at least 97%, at least 98%, at least 99%, or at least 99.5% identical to a naturally-occurring CasX or CasY protein. In some embodiments, the guide nucleotide sequence-programmable DNA-binding protein is a naturally-occurring CasX or CasY protein. In some embodiments, the guide nucleotide sequence-programmable DNA-binding protein comprises an amino acid sequence that is at least 85%, at least 90%, at least 91%, at least 92%, at least 93%, at least 94%, at least 95%, at least 96%, at least 97%, at least 98%, at least 99%, or at least 99.5% identical to any one of SEQ ID NOs: 695-697. In some embodiments, the guide nucleotide sequence-programmable DNA-binding protein comprises an amino acid sequence of any one of SEQ ID NOs: 695-697. It should be appreciated that CasX and CasY from other bacterial species may also be used in accordance with the present disclosure.

```
CasX (uniprot.org/uniprot/F0NN87; uniprot.org/uniprot/F0NH53)
>tr|F0NN87|F0NN87_SULIH CRISPR-associated Casx protein OS = Sulfolobus islandicus
(strain HVE10/4) GN = SiH_0402 PE = 4 SV = 1
                                                                    (SEQ ID NO: 695)
MEVPLYNIFGDNYIIQVATEAENSTIYNNKVEIDDEELRNVLNLAYKIAKNNEDAAAERR

GKAKKKKGEEGETTTSNIILPLSGNDKNPWTETLKCYNFPTTVALSEVFKNFSQVKECEE

VSAPSFVKPEFYEFGRSPGMVERTRRVKLEVEPHYLIIAAAGWVLTRLGKAKVSEGDYV

GVNVFTPTRGILYSLIQNVNGIVPGIKPETAFGLWIARKVVSSVTNPNVSVVRIYTISDAV

GQNPTTINGGFSIDLTKLLEKRYLLSERLEAIARNALSISSNMRERYIVLANYIYEYLTGSK

RLEDLLYFANRDLIMNLNSDDGKVRDLKLISAYVNGELIRGEG

>tr|F0NH53|F0NH53_SULIR CRISPR associated protein, Casx OS = Sulfolobus islandicus
(strain REY15A) GN = SiRe_0771 PE = 4 SV = 1
                                                                    (SEQ ID NO: 696)
MEVPLYNIFGDNYIIQVATEAENSTIYNNKVEIDDEELRNVLNLAYKIAKNNEDAAAERR

GKAKKKKGEEGETTTSNIILPLSGNDKNPWTETLKCYNFPTTVALSEVFKNFSQVKECEE

VSAPSFVKPEFYKFGRSPGMVERTRRVKLEVEPHYLIMAAAGWVLTRLGKAKVSEGDY

VGVNVFTPTRGILYSLIQNVNGIVPGIKPETAFGLWIARKVVSSVTNPNVSVVSIYTISDA

VGQNPTTINGGFSIDLTKLLEKRDLLSERLEAIARNALSISSNMRERYIVLANYIYEYLTGS

KRLEDLLYFANRDLIMNLNSDDGKVRDLKLISAYVNGELIRGEG

CasY (ncbi.nlm.nih.gov/protein/APG80656.1)
>APG80656.1 CRISPR-associated protein CasY [uncultured Parcubacteria group bacterium]
                                                                    (SEQ ID NO: 697)
MSKRHPRISGVKGYRLHAQRLEYTGKSGAMRTIKYPLYSSPSGGRTVPREIVSAINDDY

VGLYGLSNFDDLYNAEKRNEEKVYSVLDFWYDCVQYGAVFSYTAPGLLKNVAEVRGG

SYELTKTLKGSHLYDELQIDKVIKFLNKKEISRANGSLDKLKKDIIDCFKAEYRERHKDQ

CNKLADDIKNAKKDAGASLGERQKKLFRDFFGISEQSENDKPSFTNPLNLTCCLLPFDTV

NNNRNRGEVLFNKLKEYAQKLDKNEGSLEMWEYIGIGNSGTAFSNFLGEGFLGRLREN

KITELKKAMMDITDAWRGQEQEEELEKRLRILAALTIKLREPKFDNHWGGYRSDINGKL

SSWLQNYINQTVKIKEDLKGHKKDLKKAKEMINRFGESDTKEEAVVSSLLESIEKIVPDD

SADDEKPDIPAIAIYRRFLSDGRLTLNRFVQREDVQEALIKERLEAEKKKKPKKRKKKSD

AEDEKETIDFKELFPHLAKPLKLVPNFYGDSKRELYKKYKNAAIYTDALWKAVEKIYKS

AFSSSLKNSFFDTDFDKDFFIKRLQKIFSVYRRFNTDKWKPIVKNSFAPYCDIVSLAENEV

LYKPKQSRSRKSAAIDKNRVRLPSTENIAKAGIALARELSVAGFDWKDLLKKEEHEEYID

LIELHKTALALLLAVTETQLDISALDFVENGTVKDFMKTRDGNLVLEGRFLEMFSQSIVF

SELRGLAGLMSRKEFITRSAIQTMNGKQAELLYIPHEFQSAKITTPKEMSRAFLDLAPAEF

ATSLEPESLSEKSLLKLKQMRYYPHYFGYELTRTGQGIDGGVAENALRLEKSPVKKREIK

CKQYKTLGRGQNKIVLYVRSSYYQIQFLEWFLHRPKNVQTDVAVSGSFLIDEKKVKIR

WNYDALTVALEPVSGSERVFVSQPFTIFPPEKSAEEEGQRYLGIDIGEYGIAYTALEITGDS

AKILDQNFISDPQLKTLREEVKGLKLDQRRGTFAMPSTKIARIRESLVHSLRNRIHHLALK

HKAKIVYELEVSRFEEGKQKIKKVYATLKKADVYSEIDADKNLQTTVWGKLAVASEISA

SYTSQFCGACKKLWRAEMQVDETITTQELIGTVRVIKGGTLIDAIKDFMRPPIFDENDTPF

PKYRDFCDKHHISKKMRGNSCLFICPFCRANADADIQASQTIALLRYVKEEKKVEDYFE

RFRKLKNIKVLGQMKKI
```

Cas9 Domains of Nucleobase Editors

Non-limiting, exemplary Cas9 domains are provided herein. The Cas9 domain may be a nuclease active Cas9 domain, a nuclease inactive Cas9 domain, or a Cas9 nickase. In some embodiments, the Cas9 domain is a nuclease active domain. For example, the Cas9 domain may be a Cas9 domain that cuts both strands of a duplexed nucleic acid (e.g., both strands of a duplexed DNA molecule). In some embodiments, the Cas9 domain comprises any one of the amino acid sequences as set forth herein. In some embodiments the Cas9 domain comprises an amino acid sequence that is at least 60%, at least 65%, at least 70%, at least 75%, at least 80%, at least 85%, at least 90%, at least 95%, at least 96%, at least 97%, at least 98%, at least 99%, or at least 99.5% identical to any one of the amino acid sequences set forth herein. In some embodiments, the Cas9 domain comprises an amino acid sequence that has 1, 2, 3, 4, 5, 6, 7, 8, 9, 10, 11, 12, 13, 14, 15, 16, 17, 18, 19, 20, 21, 22, 21, 24, 25, 26, 27, 28, 29, 30, 31, 32, 33, 34, 35, 36, 37, 38, 39, 40, 41, 42, 43, 44, 45, 46, 47, 48, 49, 50, or more mutations compared to any one of the amino acid sequences set forth herein. In some embodiments, the Cas9 domain comprises an amino acid sequence that has at least 10, at least 15, at least 20, at least 30, at least 40, at least 50, at least 60, at least 70, at least 80, at least 90, at least 100, at least 150, at least 200, at least 250, at least 300, at least 350, at least 400, at least 500, at least 600, at least 700, at least 800, at least 900, at least 1000, at least 1100, or at least 1200 identical contiguous amino acid residues as compared to any one of the amino acid sequences set forth herein.

In some embodiments, the Cas9 domain is a nuclease-inactive Cas9 domain (dCas9). For example, the dCas9 domain may bind to a duplexed nucleic acid molecule (e.g., via a gRNA molecule) without cleaving either strand of the duplexed nucleic acid molecule. In some embodiments, the nuclease-inactive dCas9 domain comprises a D10X mutation and a H840X mutation or a corresponding mutation in any of the amino acid sequences provided in any of the Cas9 proteins provided herein, wherein X is any amino acid change. In some embodiments, the nuclease-inactive dCas9 domain comprises a D10A mutation and a H840A mutation or a corresponding mutation in any of the amino acid sequences provided in any of the Cas9 proteins provided herein. As one example, a nuclease-inactive Cas9 domain comprises the amino acid sequence set forth in SEQ ID NO: 698 (Cloning vector pPlatTET-gRNA2, Accession No. BAV54124).

MDKKYSIGLAIGTNSVGWAVITDEYKVPSKKFKVLGNTDRHSIKKNLIGA

LLFDSGETAEATRLKRTARRRYTRRKNRICYLQEIFSNEMAKVDDSFFHR

LEESFLVEEDKKHERHPIFGNIVDEVAYHEKYPTIYHLRKKLVDSTDKAD

LRLIYLALAHMIKFRGHFLIEGDLNPDNSDVDKLFIQLVQTYNQLFEENP

INASGVDAKAILSARLSKSRRLENLIAQLPGEKKNGLFGNLIALSLGLTP

NFKSNFDLAEDAKLQLSKDTYDDDLDNLLAQIGDQYADLFLAAKNLSDAI

LLSDILRVNTEITKAPLSASMIKRYDEHHQDLTLLKALVRQQLPEKYKEI

FFDQSKNGYAGYIDGGASQEEFYKFIKPILEKMDGTEELLVKLNREDLLR

KQRTFDNGSIPHQIHLGELHAILRRQEDFYPFLKDNREKIEKILTFRIPY

YVGPLARGNSRFAWMTRKSEETITPWNFEEVVDKGASAQSFIERMTNFDK

NLPNEKVLPKHSLLYEYFTVYNELTKVKYVTEGMRKPAFLSGEQKKAIVD

-continued

LLFKTNRKVTVKQLKEDYFKKIECFDSVEISGVEDRFNASLGTYHDLLKI

IKDKDFLDNEENEDILEDIVLTLTLFEDREMIEERLKTYAHLFDDKVMKQ

LKRRRYTGWGRLSRKLINGIRDKQSGKTILDFLKSDGFANRNFMQLIHDD

SLTFKEDIQKAQVSGQGDSLHEHIANLAGSPAIKKGILQTVKVVDELVKV

MGRHKPENIVIEMARENQTTQKGQKNSRERMKRIEEGIKELGSQILKEHP

VENTQLQNEKLYLYYLQNGRDMYVDQELDINRLSDYDVDAIVPQSFLKDD

SIDNKVLTRSDKNRGKSDNVPSEEVVKKMKNYWRQLLNAKLITQRKFDNL

TKAERGGLSELDKAGFIKRQLVETRQITKHVAQILDSRMNTKYDENDKLI

REVKVITLKSKLVSDFRKDFQFYKVREINNYHHAHDAYLNAVVGTALIKK

YPKLESEFVYGDYKVYDVRKMIAKSEQEIGKATAKYFFYSNIMNFFKTEI

TLANGEIRKRPLIETNGETGEIVWDKGRDFATVRKVLSMPQVNIVKKTEV

QTGGFSKESILPKRNSDKLIARKKDWDPKKYGGFDSPTVAYSVLVVAKVE

KGKSKKLKSVKELLGITIMERSSFEKNPIDFLEAKGYKEVKKDLIIKLPK

YSLFELENGRKRMLASAGELQKGNELALPSKYVNFLYLASHYEKLKGSPE

DNEQKQLFVEQHKHYLDEIIEQISEFSKRVILADANLDKVLSAYNKHRDK

PIREQAENIIHLFTLTNLGAPAAFKYFDTTIDRKRYTSTKEVLDATLIHQ

SITGLYETRIDLSQLGGD
(SEQ ID NO: 698; see, e.g., Qi et al., Repurposing CRISPR as an RNA-guided platform for sequence-specific control of gene expression. Cell. 2013; 152(5): 1173-83, the entire contents of which are incorporated herein by reference).

Additional suitable nuclease-inactive dCas9 domains will be apparent to those of skill in the art based on this disclosure and knowledge in the field, and are within the scope of this disclosure. Such additional exemplary suitable nuclease-inactive Cas9 domains include, but are not limited to, D10A/H840A, D10A/D839A/H840A, and D10A/D839A/H840A/N863A mutant domains (See, e.g., Prashant et al., CAS9 transcriptional activators for target specificity screening and paired nickases for cooperative genome engineering. *Nature Biotechnology.* 2013; 31(9): 833-838, the entire contents of which are incorporated herein by reference). In some embodiments the dCas9 domain comprises an amino acid sequence that is at least 60%, at least 65%, at least 70%, at least 75%, at least 80%, at least 85%, at least 90%, at least 95%, at least 96%, at least 97%, at least 98%, at least 99%, or at least 99.5% identical to any one of the dCas9 domains provided herein. In some embodiments, the Cas9 domain comprises an amino acid sequences that has 1, 2, 3, 4, 5, 6, 7, 8, 9, 10, 11, 12, 13, 14, 15, 16, 17, 18, 19, 20, 21, 22, 21, 24, 25, 26, 27, 28, 29, 30, 31, 32, 33, 34, 35, 36, 37, 38, 39, 40, 41, 42, 43, 44, 45, 46, 47, 48, 49, 50 or more mutations compared to any one of the amino acid sequences of Cas9 or a Cas9 variant set forth herein. In some embodiments, the Cas9 domain comprises an amino acid sequence that has at least 10, at least 15, at least 20, at least 30, at least 40, at least 50, at least 60, at least 70, at least 80, at least 90, at least 100, at least 150, at least 200, at least 250, at least 300, at least 350, at least 400, at least 500, at least 600, at least 700, at least 800, at least 900, at least 1000, at least 1100, or at least 1200 identical contiguous amino acid residues as compared to any one of the amino acid sequences of Cas9 or a Cas9 variant set forth herein.

In some embodiments, the Cas9 domain is a Cas9 nickase. The Cas9 nickase may be a Cas9 protein that is capable of cleaving only one strand of a duplexed nucleic acid molecule (e.g., a duplexed DNA molecule). In some embodiments the Cas9 nickase cleaves the target strand of a duplexed nucleic acid molecule, meaning that the Cas9 nickase cleaves the strand that is base paired to (complementary to) a gRNA (e.g., an sgRNA) that is bound to the Cas9. In some embodiments, a Cas9 nickase comprises a D10A mutation and has a histidine at position 840. For example, a Cas9 nickase may comprise the amino acid sequence as set forth in SEQ ID NO: 683. In some embodiments the Cas9 nickase comprises an amino acid sequence that is at least 60%, at least 65%, at least 70%, at least 75%, at least 80%, at least 85%, at least 90%, at least 95%, at least 96%, at least 97%, at least 98%, at least 99%, or at least 99.5% identical to any one of the Cas9 nickases provided herein. Additional suitable Cas9 nickases will be apparent to those of skill in the art based on this disclosure and knowledge in the field, and are within the scope of this disclosure.

Cas9 Domains with Reduced PAM Exclusivity

Some aspects of the disclosure provide Cas9 domains that have different PAM specificities. Typically, Cas9 proteins, such as Cas9 from *S. pyogenes* (spCas9), require a canonical NGG PAM sequence to bind a particular nucleic acid region. This may limit the ability to edit desired bases within a genome. In some embodiments, the base editing fusion proteins provided herein may need to be placed at a precise location, for example where a target base is placed within a four base region (e.g., a "deamination window"), which is approximately 15 bases upstream of the PAM. See Komor, A. C., et al., "Programmable editing of a target base in genomic DNA without double-stranded DNA cleavage" *Nature* 533, 420-424 (2016), the entire contents of which are hereby incorporated by reference. Accordingly, in some embodiments, any of the fusion proteins provided herein may contain a Cas9 domain that is capable of binding a nucleotide sequence that does not contain a canonical (e.g., NGG) PAM sequence and has relaxed PAM requirements (PAMless Cas9). PAMless Cas9 exhibits an increased activity on a target sequence that does not include a canonical PAM (e.g., NGG) sequence at its 3'-end as compared to *Streptococcus pyogenes* Cas9 as provided by SEQ ID NO: 1, e.g., increased activity by at least 5-fold, at least 10-fold, at least 50-fold, at least 100-fold, at least 500-fold, at least 1,000-fold, at least 5,000-fold, at least 10,000-fold, at least 50,000-fold, at least 100,000-fold, at least 500,000-fold, or at least 1,000,000-fold. Cas9 domains that bind to non-canonical PAM sequences have been described in the art and would be apparent to the skilled artisan. For example, Cas9 domains that bind non-canonical PAM sequences have been described in Kleinstiver, B. P., et al., "Engineered CRISPR-Cas9 nucleases with altered PAM specificities" *Nature* 523, 481-485 (2015); and Kleinstiver, B. P., et al., "Broadening the targeting range of *Staphylococcus aureus* CRISPR-Cas9 by modifying PAM recognition" *Nature Biotechnology* 33, 1293-1298 (2015); the entire contents of each are hereby incorporated by reference. See also US Provisional Applications, U.S. Ser. No. 62/245,828, filed Oct. 23, 2015; 62/279,346, filed Jan. 15, 2016; 62/311,763, filed Mar. 22, 2016; 62/322,178, filed Apr. 13, 2016; and 62/357,332, filed Jun. 30, 2016, each of which is incorporated herein by reference. In some embodiments, the dCas9 or Cas9 nickase useful in the present disclosure may further comprise mutations that relax the PAM requirements, e.g., mutations that correspond to A262T, K294R, S409I, E480K, E543D, M694I, or E1219V in SEQ ID NO: 1.

In some embodiments, the Cas9 domain is a Cas9 domain from *Staphylococcus aureus* (SaCas9). In some embodiments, the SaCas9 domain is a nuclease active SaCas9, a nuclease inactive SaCas9 (SaCas9d), or a SaCas9 nickase (SaCas9n). In some embodiments, the SaCas9 comprises the amino acid sequence SEQ ID NO: 699. In some embodiments, the SaCas9 comprises a N579X mutation of SEQ ID NO: 699, or a corresponding mutation in any of the amino acid sequences provided in any of the Cas9 proteins disclosed herein including, but not limited to, SEQ ID NOs: 1-260, 270-292, 315-323, 680, and 682, wherein X is any amino acid except for N. In some embodiments, the SaCas9 comprises a N579A mutation of SEQ ID NO: 699, or a corresponding mutation in any of the amino acid sequences provided in SEQ ID NOs: 1-260, 272-292, 315-323, 680, and 682. In some embodiments, the SaCas9 domain, the SaCas9d domain, or the SaCas9n domain can bind to a nucleic acid sequence having a non-canonical PAM. In some embodiments, the SaCas9 domain, the SaCas9d domain, or the SaCas9n domain can bind to a nucleic acid sequence having a NNGRRT PAM sequence. In some embodiments, the SaCas9 domain comprises one or more of a E781X, a N967X, and a R1014X mutation of SEQ ID NO: 699, or a corresponding mutation in any of the Cas9 amino acid sequences provided herein, including but not limited to in SEQ ID NOs: 1-260, 270-292, 315-323, 680, or 682, wherein X is any amino acid. In some embodiments, the SaCas9 domain comprises one or more of a E781K, a N967K, and a R1014H mutation of SEQ ID NO: 699, or one or more corresponding mutation in any of the Cas9 amino acid sequences provided herein, including but not limited to in SEQ ID NOs: 1-260, 270-292, 315-323, 680, or 682. In some embodiments, the SaCas9 domain comprises a E781K, a N967K, or a R1014H mutation of SEQ ID NO: 699, or one or more corresponding mutation in any of the Cas9 amino acid sequences provided herein, including but not limited to in SEQ ID NOs: 1-260, 270-292, 315-323, 680, or 682.

In some embodiments, the Cas9 domain of any of the fusion proteins provided herein comprises an amino acid sequence that is at least 60%, at least 65%, at least 70%, at least 75%, at least 80%, at least 85%, at least 90%, at least 95%, at least 96%, at least 97%, at least 98%, at least 99%, or at least 99.5% identical to any one of SEQ ID NOs: 699-701. In some embodiments, the Cas9 domain of any of the fusion proteins provided herein comprises the amino acid sequence of any one of SEQ ID NOs: 699-701. In some embodiments, the Cas9 domain of any of the fusion proteins provided herein consists of the amino acid sequence of any one of SEQ ID NOs: 699-701.

Exemplary SaCas9 sequence (SEQ ID NO: 699)

KRNYILGLDIGITSVGYGIIDYETRDVIDAGVRLFKEANVENNEGRRSKRGARRLKRRRR

HRIQRVKKLLFDYNLLTDHSELSGINPYEARVKGLSQKLSEEEFSAALLHLAKRRGVHN

VNEVEEDTGNELSTKEQISRNSKALEEKYVAELQLERLKKDGEVRGSINRFKTSDYVKE

AKQLLKVQKAYHQLDQSFIDTYIDLLETRRTYYEGPGEGSPFGWKDIKEWYEMLMGHC

-continued

```
TYFPEELRSVKYAYNADLYNALNDLNNLVITRDENEKLEYYEKFQIIENVFKQKKKPTL
KQIAKEILVNEEDIKGYRVTSTGKPEFTNLKVYHDIKDITARKEIIENAELLDQIAKILTIY
QSSEDIQEELTNLNSELTQEEIEQISNLKGYTGTHNLSLKAINLILDELWHTNDNQIAIFNR
LKLVPKKVDLSQQKEIPTTLVDDFILSPVVKRSFIQSIKVINAIIKKYGLPNDIIIELAREKN
SKDAQKMINEMQKRNRQTNERIEEIIRTTGKENAKYLIEKIKLHDMQEGKCLYSLEAIPL
EDLLNNPFNYEVDHIIPRSVSFDNSFNNKVLVKQEENSKKGNRTPFQYLSSSDSKISYETF
KKHILNLAKGKGRISKTKKEYLLEERDINRFSVQKDFINRNLVDTRYATRGLMNLLRSYF
RVNNLDVKVKSINGGFTSFLRRKWKFKKERNKGYKHHAEDALIIANADFIFKEWKKLD
KAKKVMENQMFEEKQAESMPEIETEQEYKEIFITPHQIKHIKDFKDYKYSHRVDKKPNR
ELINDTLYSTRKDDKGNTLIVNNLNGLYDKDNDKLKKLINKSPEKLLMYHHDPQTYQK
LKLIMEQYGDEKNPLYKYYEETGNYLTKYSKKDNGPVIKKIKYYGNKLNAHLDITDDY
PNSRNKVVKLSLKPYRFDVYLDNGVYKFVTVKNLDVIKKENYYEVNSKCYEEAKKLK
KISNQAEFIASFYNNDLIKINGELYRVIGVNNDLLNRIEVNMIDITYREYLENMNDKRPPR
IIKTIASKTQSIKKYSTDILGNLYEVKSKKHPQIIKKG
```
Residue N579 of SEQ ID NO: 699, which is underlined and in bold, may be mutated (e.g., to a A579) to yield a SaCas9 nickase.

Exemplary SaCas9d sequence (SEQ ID NO: 702)
```
KRNYILGLAIGITSVGYGIIDYETRDVIDAGVRLFKEANVENNEGRRSKRGARRLKRRRR
HRIQRVKKLLFDYNLLTDHSELSGINPYEARVKGLSQKLSEEEFSAALLHLAKRRGVHN
VNEVEEDTGNELSTKEQISRNSKALEEKYVAELQLERLKKDGEVRGSINTRFKTSDYVKE
AKQLLKVQKAYHQLDQSFIDTYIDLLETRRTYYEGPGEGSPFGWKDIKEWYEMLMGHC
TYFPEELRSVKYAYNADLYNALNDLNNLVITRDENEKLEYYEKFQIIENVFKQKKKPTL
KQIAKEILVNEEDIKGYRVTSTGKPEFTNLKVYHDIKDITARKEIIENAELLDQIAKILTIY
QSSEDIQEELTNLNSELTQEEIEQISNLKGYTGTHNLSLKAINLILDELWHTNDNQIAIFNR
LKLVPKKVDLSQQKEIPTTLVDDFILSPVVKRSFIQSIKVINAIIKKYGLPNDIIIELAREKN
SKDAQKMINEMQKRNRQTNERIEEIIRTTGKENAKYLIEKIKLHDMQEGKCLYSLEAIPL
EDLLNNPFNYEVDHIIPRSVSFDNSFNNKVLVKQEENSKKGNRTPFQYLSSSDSKISYETF
KKHILNLAKGKGRISKTKKEYLLEERDINRFSVQKDFINRNLVDTRYATRGLMNLLRSYF
RVNNLDVKVKSINGGFTSFLRRKWKFKKERNKGYKHHAEDALIIANADFIFKEWKKLD
KAKKVMENQMFEEKQAESMPEIETEQEYKEIFITPHQIKHIKDFKDYKYSHRVDKKPNR
ELINDTLYSTRKDDKGNTLIVNNLNGLYDKDNDKLKKLINKSPEKLLMYHHDPQTYQK
LKLIMEQYGDEKNPLYKYYEETGNYLTKYSKKDNGPVIKKIKYYGNKLNAHLDITDDY
PNSRNKVVKLSLKPYRFDVYLDNGVYKFVTVKNLDVIKKENYYEVNSKCYEEAKKLK
KISNQAEFIASFYNNDLIKINGELYRVIGVNNDLLNRIEVNMIDITYREYLENMNDKRPPR
IIKTIASKTQSIKKYSTDILGNLYEVKSKKHPQIIKKG
```
Residue D10 of SEQ ID NO: 702, which is underlined and in bold, may be mutated (e.g., to a A10) to yield a nuclease inactive SaCas9d.

Exemplary SaCas9n sequence (SEQ ID NO: 700)
```
KRNYILGLDIGITSVGYGIIDYETRDVIDAGVRLFKEANVENNEGRRSKRGARRLKRRRR
HRIQRVKKLLFDYNLLTDHSELSGINPYEARVKGLSQKLSEEEFSAALLHLAKRRGVHN
VNEVEEDTGNELSTKEQISRNSKALEEKYVAELQLERLKKDGEVRGSINTRFKTSDYVKE
AKQLLKVQKAYHQLDQSFIDTYIDLLETRRTYYEGPGEGSPFGWKDIKEWYEMLMGHC
```

-continued

TYFPEELRSVKYAYNADLYNALNDLNNLVITRDENEKLEYYEKFQIIENVFKQKKKPTL

KQIAKEILVNEEDIKGYRVTSTGKPEFTNLKVYHDIKDITARKEIIENAELLDQIAKILTIY

QSSEDIQEELTNLNSELTQEEIEQISNLKGYTGTHNLSLKAINLILDELWHTNDNQIAIFNR

LKLVPKKVDLSQQKEIPTTLVDDFILSPVVKRSFIQSIKVINAIIKKYGLPNDIIIELAREKN

SKDAQKMINEMQKRNRQTNERIEEIIRTTGKENAKYLIEKIKLHDMQEGKCLYSLEAIPL

EDLLNNPFNYEVDHIIPRSVSFDNSFNNKVLVKQEEASKKGNRTPFQYLSSSDSKISYETF

KKHILNLAKGKGRISKTKKEYLLEERDINRFSVQKDFINRNLVDTRYATRGLMNLLRSYF

RVNNLDVKVKSINGGFTSFLRRKWKFKKERNKGYKHHAEDALIIANADFIFKEWKKLD

KAKKVMENQMFEEKQAESMPEIETEQEYKEIFITPHQIKHIKDFKDYKYSHRVDKKPNR

ELINDTLYSTRKDDKGNTLIVNNLNGLYDKDNDKLKKLINKSPEKLLMYHHDPQTYQK

LKLIMEQYGDEKNPLYKYYEETGNYLTKYSKKDNGPVIKKIKYYGNKLNAHLDITDDY

PNSRNKVVKLSLKPYRFDVYLDNGVYKFVTVKNLDVIKKENYYEVNSKCYEEAKKLK

KISNQAEFIASFYNNDLIKINGELYRVIGVNNDLLNRIEVNMIDITYREYLENMNDKRPPR

IIKTIASKTQSIKKYSTDILGNLYEVKSKKHPQIIKKG.
Residue A579 of SEQ ID NO: 700, which can be mutated from N579 of SEQ ID NO:
699 to yield a SaCas9 nickase, is underlined and in bold.

Exemplary SaKKH Cas9

(SEQ ID NO: 701)
KRNYILGLDIGITSVGYGIIDYETRDVIDAGVRLFKEANVENNEGRRSKRGARRLKRRRR

HRIQRVKKLLFDYNLLTDHSELSGINPYEARVKGLSQKLSEEEFSAALLHLAKRRGVHN

VNEVEEDTGNELSTKEQISRNSKALEEKYVAELQLERLKKDGEVRGSINTRFKTSDYVKE

AKQLLKVQKAYHQLDQSFIDTYIDLLETRRTYYEGPGEGSPFGWKDIKEWYEMLMGHC

TYFPEELRSVKYAYNADLYNALNDLNNLVITRDENEKLEYYEKFQIIENVFKQKKKPTL

KQIAKEILVNEEDIKGYRVTSTGKPEFTNLKVYHDIKDITARKEIIENAELLDQIAKILTIY

QSSEDIQEELTNLNSELTQEEIEQISNLKGYTGTHNLSLKAINLILDELWHTNDNQIAIFNR

LKLVPKKVDLSQQKEIPTTLVDDFILSPVVKRSFIQSIKVINAIIKKYGLPNDIIIELAREKN

SKDAQKMINEMQKRNRQTNERIEEIIRTTGKENAKYLIEKIKLHDMQEGKCLYSLEAIPL

EDLLNNPFNYEVDHIIPRSVSFDNSFNNKVLVKQEEASKKGNRTPFQYLSSSDSKISYETF

KKHILNLAKGKGRISKTKKEYLLEERDINRFSVQKDFINRNLVDTRYATRGLMNLLRSYF

RVNNLDVKVKSINGGFTSFLRRKWKFKKERNKGYKHHAEDALIIANADFIFKEWKKLD

KAKKVMENQMFEEKQAESMPEIETEQEYKEIFITPHQIKHIKDFKDYKYSHRVDKKPNR

*K*LINDTLYSTRKDDKGNTLIVNNLNGLYDKDNDKLKKLINKSPEKLLMYHHDPQTYQK

LKLIMEQYGDEKNPLYKYYEETGNYLTKYSKKDNGPVIKKIKYYGNKLNAHLDITDDY

PNSRNKVVKLSLKPYRFDVYLDNGVYKFVTVKNLDVIKKENYYEVNSKCYEEAKKLK

KISNQAEFIASFY*K*NDLIKINGELYRVIGVNNDLLNRIEVNMIDITYREYLENMNDKRPP*H*

IIKTIASKTQSIKKYSTDILGNLYEVKSKKHPQIIKKG.
Residue A579 of SEQ ID NO: 701, which can be mutated from N579 of SEQ ID NO: 699 to
yield a SaCas9 nickase, is underlined and in bold. Residues K781, K967, and H1014 of SEQ ID
NO: 701, which can be mutated from E781, N967, and R1014 of SEQ ID NO: 699 to yield a
SaKKH Cas9 are underlined and in italics.

In some embodiments, the Cas9 domain is a Cas9 domain from *Streptococcus pyogenes* (SpCas9). In some embodiments, the SpCas9 domain is a nuclease active SpCas9, a nuclease inactive SpCas9 (SpCas9d), or a SpCas9 nickase (SpCas9n). In some embodiments, the SpCas9 comprises the amino acid sequence SEQ ID NO: 703. In some embodiments, the SpCas9 comprises a D9X mutation of SEQ ID NO: 703, or a corresponding mutation in any of the Cas9 amino acid sequences provided herein, including but not limited to SEQ ID NOs: 1-260, 270-292, 315-323, 680, or 682, wherein X is any amino acid except for D. In some embodiments, the SpCas9 comprises a D9A mutation of SEQ ID NO: 703, or a corresponding mutation in any of the Cas9 amino acid sequences provided herein, including but not limited to SEQ ID NOs: 1-260, 270-292, 315-323, 680, or 682. In some embodiments, the SpCas9 domain, the SpCas9d domain, or the SpCas9n domain can bind to a nucleic acid sequence having a non-canonical PAM. In some embodiments, the SpCas9 domain, the SpCas9d domain, or the SpCas9n domain can bind to a nucleic acid sequence having a NGG, a NGA, or a NGCG PAM sequence. In some embodiments, the SpCas9 domain comprises one or more of a D1134X, a R1334X, and a T1336X mutation of SEQ ID NO: 703, or a corresponding mutation in any of the Cas9 amino acid sequences provided herein, including but not limited to SEQ ID NOs: 1-260, 270-292, 315-323, 680, or 682, wherein X is any amino acid. In some embodiments, the SpCas9 domain comprises one or more of a D1134E, R1334Q, and T1336R mutation of SEQ ID NO: 703, or a corresponding mutation in any of the Cas9 amino acid sequences provided herein, including but not limited to SEQ ID NOs: 1-260, 270-292, 315-323, 680, or 682. In some embodiments, the SpCas9 domain comprises a D1134E, a R1334Q, and a T1336R mutation of SEQ ID NO: 703, or a corresponding mutation in any of the Cas9 amino acid sequences provided herein, including but not limited to SEQ ID NOs: 1-260, 270-292, 315-323, 680, or 682. In some embodiments, the SpCas9 domain comprises one or more of a D1134X, a R1334X, and a T1336X mutation of SEQ ID NO: 703, or a corresponding mutation in any of the Cas9 amino acid sequences provided herein, including but not limited to SEQ ID NOs: 1-260, 270-292, 315-323, 680, or 682, wherein X is any amino acid. In some embodiments, the SpCas9 domain comprises one or more of a D1134V, a R1334Q, and a T1336R mutation of SEQ ID NO: 703, or a corresponding mutation in any of the Cas9 amino acid sequences provided herein, including but not limited to SEQ ID NOs: 1-260, 270-292, 315-323, 680, or 682. In some embodiments, the SpCas9 domain comprises a D1134V, a R1334Q, and a T1336R mutation of SEQ ID NO: 703, or a corresponding mutation in any of the Cas9 amino acid sequences provided herein, including but not limited to SEQ ID NOs: 1-260, 270-292, 315-323, 680, or 682. In some embodiments, the SpCas9 domain comprises one or more of a D1134X, a G1217X, a R1334X, and a T1336X mutation of SEQ ID NO: 703, or a corresponding mutation in any of the Cas9 amino acid sequences provided herein, including but not limited to SEQ ID NOs: 1-260, 270-292, 315-323, 680, or 682, wherein X is any amino acid. In some embodiments, the SpCas9 domain comprises one or more of a D1134V, a G1217R, a R1334Q, and a T1336R mutation of SEQ ID NO: 703, or a corresponding mutation in any of the Cas9 amino acid sequences provided herein, including but not limited to, SEQ ID NOs: 1-260, 270-292, 315-323, 680, or 682. In some embodiments, the SpCas9 domain comprises a D1134V, a G1217R, a R1334Q, and a T1336R mutation of SEQ ID NO: 703, or a corresponding mutation in any of the Cas9 amino acid sequences provided herein, including but not limited to SEQ ID NOs: 1-260, 270-292, 315-323, 680, or 682.

In some embodiments, the Cas9 domain of any of the fusion proteins provided herein comprises an amino acid sequence that is at least 60%, at least 65%, at least 70%, at least 75%, at least 80%, at least 85%, at least 90%, at least 95%, at least 96%, at least 97%, at least 98%, at least 99%, or at least 99.5% identical to any one of SEQ ID NOs: 4276-4280. In some embodiments, the Cas9 domain of any of the fusion proteins provided herein comprises the amino acid sequence of any one of SEQ ID NOs: 703-707. In some embodiments, the Cas9 domain of any of the fusion proteins provided herein consists of the amino acid sequence of any one of SEQ ID NOs: 703-707.

Exemplary SpCas9
(SEQ ID NO: 703)
DKKYSIGLDIGTNSVGWAVITDEYKVPSKKFKVLGNTDRHSIKKNLIGAL

LFDSGETAEATRLKRTARRRYTRRKNRICYLQEIFSNEMAKVDDSFFHRL

EESFLVEEDKKHERHPIFGNIVDEVAYHEKYPTIYHLRKKLVDSTDKADL

RLIYLALAHMIKFRGHFLIEGDLNPDNSDVDKLFIQLVQTYNQLFEENPI

NASGVDAKAILSARLSKSRRLENLIAQLPGEKKNGLFGNLIALSLGLTPN

FKSNFDLAEDAKLQLSKDTYDDDLDNLLAQIGDQYADLFLAAKNLSDAIL

LSDILRVNTEITKAPLSASMIKRYDEHHQDLTLLKALVRQQLPEKYKEIF

FDQSKNGYAGYIDGGASQEEFYKFIKPILEKMDGTEELLVKLNREDLLRK

QRTFDNGSIPHQIHLGELHAIRRQEDFYPFLKDNREKIEKILTFRIPYYV

GPLARGNSRFAWMTRKSEETITPWNFEEVVDKGASAQSFIERMTNFDKNL

PNEKVLPKHSLLYEYFTVYNELTKVKYVTEGMRKPAFLSGEQKKAIVDLL

FKTNRKVTVKQLKEDYFKKIECFDSVEISGVEDRFNASLGTYHDLLKIIK

DKDFLDNEENEDILEDIVLTLTLFEDREMIEERLKTYAHLFDDKVMKQLK

RRRYTGWGRLSRKLINGIRDKQSGKTILDFLKSDGFANRNFMQLIHDDSL

TFKEDIQKAQVSGQGDSLHEHIANLAGSPAIKKGILQTVKVVDELVKVMG

RHKPENIVIEMARENQTTQKGQKNSRERMKRIEEGIKELGSQILKEHPVE

NTQLQNEKLYLYYLQNGRDMYVDQELDINRLSDYDVDHIVPQSFLKDDSI

DNKVLTRSDKNRGKSDNVPSEEVVKKMKNYWRQLLNAKLITQRKFDNLTK

AERGGLSELDKAGFIKRQLVETRQITKHVAQILDSRMNTKYDENDKLIRE

VKVITLKSKLVSDFRKDFQFYKVREINNYHHAHDAYLNAVVGTALIKKYP

KLESEFVYGDYKVYDVRKMIAKSEQEIGKATAKYFFYSNIMNFFKTEITL

ANGEIRKRPLIETNGETGEIVWDKGRDFATVRKVLSMPQVNIVKKTEVQT

GGFSKESILPKRNSDKLIARKKDWDPKKYGGFDSPTVAYSVLVVAKVEKG

KSKKLKSVKELLGITIMERSSFEKNPIDFLEAKGYKEVKKDLIIKLPKYS

LFELENGRKRMLASAGELQKGNELALPSKYVNFLYLASHYEKLKGSPEDN

EQKQLFVEQHKHYLDEIIEQISEFSKRVILADANLDKVLSAYNKHRDKPI

REQAENIIHLFTLTNLGAPAAFKYFDTTIDRKRYTSTKEVLDATLIHQSI

TGLYETRIDLSQLGGD

-continued

Exemplary SpCas9n
(SEQ ID NO: 704)
DKKYSIGLAIGTNSVGWAVITDEYKVPSKKFKVLGNTDRHSIKKNLIGAL

LFDSGETAEATRLKRTARRRYTRRKNRICYLQEIFSNEMAKVDDSFFHRL

EESFLVEEDKKHERHPIFGNIVDEVAYHEKYPTIYHLRKKLVDSTDKADL

RLIYLALAHMIKFRGHFLIEGDLNPDNSDVDKLFIQLVQTYNQLFEENPI

NASGVDAKAILSARLSKSRRLENLIAQLPGEKKNGLFGNLIALSLGLTPN

FKSNFDLAEDAKLQLSKDTYDDDLDNLLAQIGDQYADLFLAAKNLSDAIL

LSDILRVNTEITKAPLSASMIKRYDEHHQDLTLLKALVRQQLPEKYKEIF

FDQSKNGYAGYIDGGASQEEFYKFIKPILEKMDGTEELLVKLNREDLLRK

QRTFDNGSIPHQIHLGELHAILRRQEDFYPFLKDNREKIEKILTFRIPYY

VGPLARGNSRFAWMTRKSEETITPWNFEEVVDKGASAQSFIERMTNFDKN

LPNEKVLPKHSLLYEYFTVYNELTKVKYVTEGMRKPAFLSGEQKKAIVDL

LFKTNRKVTVKQLKEDYFKKIECFDSVEISGVEDRFNASLGTYHDLLKII

KDKDFLDNEENEDILEDIVLTLTLFEDREMIEERLKTYAHLFDDKVMKQL

KRRRYTGWGRLSRKLINGIRDKQSGKTILDFLKSDGFANRNFMQLIHDDS

LTFKEDIQKAQVSGQGDSLHEHIANLAGSPAIKKGILQTVKVVDELVKVM

GRHKPENIVIEMARENQTTQKGQKNSRERMKRIEEGIKELGSQILKEHPV

ENTQLQNEKLYLYYLQNGRDMYVDQELDINRLSDYDVDHIVPQSFLKDDS

IDNKVLTRSDKNRGKSDNVPSEEVVKKMKNYWRQLLNAKLITQRKFDNLT

KAERGGLSELDKAGFIKRQLVETRQITKHVAQILDSRMNTKYDENDKLIR

EVKVITLKSKLVSDFRKDFQFYKVREINNYHHAHDAYLNAVVGTALIKKY

PKLESEFVYGDYKVYDVRKMIAKSEQEIGKATAKYFFYSNIMNFFKTEIT

LANGEIRKRPLIETNGETGEIVWDKGRDFATVRKVLSMPQVNIVKKTEVQ

TGGFSKESILPKRNSDKLIARKKDWDPKKYGGFDSPTVAYSVLVVAKVEK

GKSKKLKSVKELLGITIMERSSFEKNPIDFLEAKGYKEVKKDLIIKLPKY

SLFELENGRKRMLASAGELQKGNELALPSKYVNFLYLASHYEKLKGSPED

NEQKQLFVEQHKHYLDEIIEQISEFSKRVILADANLDKVLSAYNKHRDKP

IREQAENIIHLFTLTNLGAPAAFKYFDTTIDRKRYTSTKEVLDATLIHQS

ITGLYETRIDLSQLGGD

Exemplary SpEQR Cas9
(SEQ ID NO: 705)
DKKYSIGLAIGTNSVGWAVITDEYKVPSKKFKVLGNTDRHSIKKNLIGAL

LFDSGETAEATRLKRTARRRYTRRKNRICYLQEIFSNEMAKVDDSFFHRL

EESFLVEEDKKHERHPIFGNIVDEVAYHEKYPTIYHLRKKLVDSTDKADL

RLIYLALAHMIKFRGHFLIEGDLNPDNSDVDKLFIQLVQTYNQLFEENPI

NASGVDAKAILSARLSKSRRLENLIAQLPGEKKNGLFGNLIALSLGLTPN

FKSNFDLAEDAKLQLSKDTYDDDLDNLLAQIGDQYADLFLAAKNLSDAIL

LSDILRVNTEITKAPLSASMIKRYDEHHQDLTLLKALVRQQLPEKYKEIF

FDQSKNGYAGYIDGGASQEEFYKFIKPILEKMDGTEELLVKLNREDLLRK

QRTFDNGSIPHQIHLGELHAILRRQEDFYPFLKDNREKIEKILTFRIPYY

VGPLARGNSRFAWMTRKSEETITPWNFEEVVDKGASAQSFIERMTNFDKN

LPNEKVLPKHSLLYEYFTVYNELTKVKYVTEGMRKPAFLSGEQKKAIVDL

LFKTNRKVTVKQLKEDYFKKIECFDSVEISGVEDRFNASLGTYHDLLKII

KDKDFLDNEENEDILEDIVLTLTLFEDREMIEERLKTYAHLFDDKVMKQL

KRRRYTGWGRLSRKLINGIRDKQSGKTILDFLKSDGFANRNFMQLIHDDS

LTFKEDIQKAQVSGQGDSLHEHIANLAGSPAIKKGILQTVKVVDELVKVM

GRHKPENIVIEMARENQTTQKGQKNSRERMKRIEEGIKELGSQILKEHPV

ENTQLQNEKLYLYYLQNGRDMYVDQELDINRLSDYDVDHIVPQSFLKDDS

IDNKVLTRSDKNRGKSDNVPSEEVVKKMKNYWRQLLNAKLITQRKFDNLT

KAERGGLSELDKAGFIKRQLVETRQITKHVAQILDSRMNTKYDENDKLIR

EVKVITLKSKLVSDFRKDFQFYKVREINNYHHAHDAYLNAVVGTALIKKY

PKLESEFVYGDYKVYDVRKMIAKSEQEIGKATAKYFFYSNIMNFFKTEIT

LANGEIRKRPLIETNGETGEIVWDKGRDFATVRKVLSMPQVNIVKKTEVQ

TGGFSKESILPKRNSDKLIARKKDWDPKKYGGFESPTVAYSVLVVAKVEK

GKSKKLKSVKELLGITIMERSSFEKNPIDFLEAKGYKEVKKDLIIKLPKY

SLFELENGRKRMLASAGELQKGNELALPSKYVNFLYLASHYEKLKGSPED

NEQKQLFVEQHKHYLDEIIEQISEFSKRVILADANLDKVLSAYNKHRDKP

IREQAENIIHLFTLTNLGAPAAFKYFDTTIDRKQYR**STKEVLDATLIHQS

ITGLYETRIDLSQLGGD

Residues E1134, Q1334, and R1336 of SEQ ID NO: 705, which can be mutated from D1134, R1334, and T1336 of SEQ ID NO: 703 to yield a SpEQR Cas9, are underlined and in bold.

Exemplary SpVQR Cas9
(SEQ ID NO: 706)
DKKYSIGLAIGTNSVGWAVITDEYKVPSKKFKVLGNTDRHSIKKNLIGAL

LFDSGETAEATRLKRTARRRYTRRKNRICYLQEIFSNEMAKVDDSFFHRL

EESFLVEEDKKHERHPIFGNIVDEVAYHEKYPTIYHLRKKLVDSTDKADL

RLIYLALAHMIKFRGHFLIEGDLNPDNSDVDKLFIQLVQTYNQLFEENPI

NASGVDAKAILSARLSKSRRLENLIAQLPGEKKNGLFGNLIALSLGLTPN

FKSNFDLAEDAKLQLSKDTYDDDLDNLLAQIGDQYADLFLAAKNLSDAIL

LSDILRVNTEITKAPLSASMIKRYDEHHQDLTLLKALVRQQLPEKYKEIF

FDQSKNGYAGYIDGGASQEEFYKFIKPILEKMDGTEELLVKLNREDLLRK

QRTFDNGSIPHQIHLGELHAILRRQEDFYPFLKDNREKIEKILTFRIPYY

VGPLARGNSRFAWMTRKSEETITPWNFEEVVDKGASAQSFIERMTNFDKN

LPNEKVLPKHSLLYEYFTVYNELTKVKYVTEGMRKPAFLSGEQKKAIVDL

LFKTNRKVTVKQLKEDYFKKIECFDSVEISGVEDRFNASLGTYHDLLKII

KDKDFLDNEENEDILEDIVLTLTLFEDREMIEERLKTYAHLFDDKVMKQL

KRRRYTGWGRLSRKLINGIRDKQSGKTILDFLKSDGFANRNFMQLIHDDS

LTFKEDIQKAQVSGQGDSLHEHIANLAGSPAIKKGILQTVKVVDELVKVM

GRHKPENIVIEMARENQTTQKGQKNSRERMKRIEEGIKELGSQILKEHPV

ENTQLQNEKLYLYYLQNGRDMYVDQELDINRLSDYDVDHIVPQSFLKDDS

IDNKVLTRSDKNRGKSDNVPSEEVVKKMKNYWRQLLNAKLITQRKFDNLT

KAERGGLSELDKAGFIKRQLVETRQITKHVAQILDSRMNTKYDENDKLIR

EVKVITLKSKLVSDFRKDFQFYKVREINNYHHAHDAYLNAVVGTALIKKY

```
PKLESEFVYGDYKVYDVRKMIAKSEQEIGKATAKYFFYSNIMNFFKTEIT

LANGEIRKRPLIETNGETGEIVWDKGRDFATVRKVLSMPQVNIVKKTEVQ

TGGFSKESILPKRNSDKLIARKKDWDPKKYGGFVSPTVAYSVLVVAKVEK

GKSKKLKSVKELLGITIMERSSFEKNPIDFLEAKGYKEVKKDLIIKLPKY

SLFELENGRKRMLASAGELQKGNELALPSKYVNFLYLASHYEKLKGSPED

NEQKQLFVEQHKHYLDEIIEQISEFSKRVILADANLDKVLSAYNKHRDKP

IREQAENIIHLFTLTNLGAPAAFKYFDTTIDRKQYRSTKEVLDATLIHQS

ITGLYETRIDLSQLGGD
Residues V1134, Q1334, and R1336 of SEQ ID NO: 706,
which can be mutated from D1134, R1334, and T1336
of SEQ ID NO: 703 to yield a SpVQR Cas9, are
underlined and in bold.

Exemplary SpVRER Cas9
                                    (SEQ ID NO: 707)
DKKYSIGLAIGTNSVGWAVITDEYKVPSKKFKVLGNTDRHSIKKNLIGAL

LFDSGETAEATRLKRTARRRYTRRKNRICYLQEIFSNEMAKVDDSFFHRL

EESFLVEEDKKHERHPIFGNIVDEVAYHEKYPTIYHLRKKLVDSTDKADL

RLIYLALAHMIKFRGHFLIEGDLNPDNSDVDKLFIQLVQTYNQLFEENPI

NASGVDAKAILSARLSKSRRLENLIAQLPGEKKNGLFGNLIALSLGLTPN

FKSNFDLAEDAKLQLSKDTYDDDLDNLLAQIGDQYADLFLAAKNLSDAIL

LSDILRVNTEITKAPLSASMIKRYDEHHQDLTLLKALVRQQLPEKYKEIF

FDQSKNGYAGYIDGGASQEEFYKFIKPILEKMDGTEELLVKLNREDLLRK

QRTFDNGSIPHQIHLGELHAILRRQEDFYPFLKDNREKIEKILTFRIPYY

VGPLARGNSRFAWMTRKSEETITPWNFEEVVDKGASAQSFIERMTNFDKN

LPNEKVLPKHSLLYEYFTVYNELTKVKYVTEGMRKPAFLSGEQKKAIVDL

LFKTNRKVTVKQLKEDYFKKIECFDSVEISGVEDRFNASLGTYHDLLKII

KDKDFLDNEENEDILEDIVLTLTLFEDREMIEERLKTYAHLFDDKVMKQL

KRRRYTGWGRLSRKLINGIRDKQSGKTILDFLKSDGFANRNFMQLIHDDS

LTFKEDIQKAQVSGQGDSLHEHIANLAGSPAIKKGILQTVKVVDELVKVM

GRHKPENIVIEMARENQTTQKGQKNSRERMKRIEEGIKELGSQILKEHPV

ENTQLQNEKLYLYYLQNGRDMYVDQELDINRLSDYDVDHIVPQSFLKDDS

IDNKVLTRSDKNRGKSDNVPSEEVVKKMKNYWRQLLNAKLITQRKFDNLT

KAERGGLSELDKAGFIKRQLVETRQITKHVAQILDSRMNTKYDENDKLIR

EVKVITLKSKLVSDFRKDFQFYKVREINNYHHAHDAYLNAVVGTALIKKY

PKLESEFVYGDYKVYDVRKMIAKSEQEIGKATAKYFFYSNIMNFFKTEIT

LANGEIRKRPLIETNGETGEIVWDKGRDFATVRKVLSMPQVNIVKKTEVQ

TGGFSKESILPKRNSDKLIARKKDWDPKKYGGFVSPTVAYSVLVVAKVEK

GKSKKLKSVKELLGITIMERSSFEKNPIDFLEAKGYKEVKKDLIIKLPKY

SLFELENGRKRMLASARELQKGNELALPSKYVNFLYLASHYEKLKGSPED

NEQKQLFVEQHKHYLDEIIEQISEFSKRVILADANLDKVLSAYNKHRDKP

IREQAENIIHLFTLTNLGAPAAFKYFDTTIDRKEYRSTKEVLDATLIHQS

ITGLYETRIDLSQLGGD
Residues V1134, R1217, Q1334, and R1336 of SEQ ID
NO: 707, which can be mutated from D1134, G1217,
R1334, and T1336 of SEQ ID NO: 703 to yield a
SpVRER Cas9, are underlined and in bold.
```

High Fidelity Base Editors

Some aspects of the disclosure provide Cas9 fusion proteins (e.g., any of the fusion proteins provided herein) comprising a Cas9 domain that has high fidelity. Additional aspects of the disclosure provide Cas9 fusion proteins (e.g., any of the fusion proteins provided herein) comprising a Cas9 domain with decreased electrostatic interactions between the Cas9 domain and a sugar-phosphate backbone of a DNA, as compared to a wild-type Cas9 domain. In some embodiments, a Cas9 domain (e.g., a wild type Cas9 domain) comprises one or more mutations that decreases the association between the Cas9 domain and a sugar-phosphate backbone of a DNA. In some embodiments, any of the Cas9 fusion proteins provided herein comprise one or more of a N497X, a R661X, a Q695X, and/or a Q926X mutation of the amino acid sequence provided in SEQ ID NO: 1, or a corresponding mutation in any of the Cas9 amino acid sequences provided herein, including but not limited to the sequences seen in SEQ ID NOs: 1-260, 270-292, and 315-323, wherein X is any amino acid. In some embodiments, any of the Cas9 fusion proteins provided herein comprise one or more of a N497A, a R661A, a Q695A, and/or a Q926A mutation of the amino acid sequence provided in SEQ ID NO: 1, or a corresponding mutation in any of the Cas9 amino acid sequences provided herein, including but not limited to the sequences seen in SEQ ID NOs: 1-260, 270-292, 315-323, 680, and 682. In some embodiments, the Cas9 domain comprises a D10A mutation of the amino acid sequence provided in SEQ ID NO: 1, or a corresponding mutation in any of the Cas9 amino acid sequences provided herein, including but not limited to the sequences seen in SEQ ID NOs: 1-260, 270-292, 315-323, 680, and 682. In some embodiments, the Cas9 domain (e.g., of any of the fusion proteins provided herein) comprises the amino acid sequence as set forth in SEQ ID NO: 708. In some embodiments, the fusion protein comprises the amino acid sequence as set forth in SEQ ID NO: 709. Cas9 domains with high fidelity are known in the art and would be apparent to the skilled artisan. For example, Cas9 domains with high fidelity have been described in Kleinstiver, B. P., et al. "High-fidelity CRISPR-Cas9 nucleases with no detectable genome-wide off-target effects." *Nature* 529, 490-495 (2016); and Slaymaker, I. M., et al. "Rationally engineered Cas9 nucleases with improved specificity." *Science* 351, 84-88 (2015); the entire contents of each are incorporated herein by reference.

It should be appreciated that the base editors provided herein, for example, base editor 2 (BE2) or base editor 3 (BE3), may be converted into high fidelity base editors by modifying the Cas9 domain as described herein to generate high fidelity base editors, for example, high fidelity base editor 2 (HF-BE2) or high fidelity base editor 3 (HF-BE3). In some embodiments, base editor 2 (BE2) comprises a deaminase domain, a dCas9 domain, and a UGI domain. In some embodiments, base editor 3 (BE3) comprises a deaminase domain, a nCas9 domain, and a UGI domain.

```
Cas9 domain where mutations relative to Cas9 of
SEQ ID NO: 1 are shown in bold and underlines
                                    (SEQ ID NO: 708)
DKKYSIGLAIGTNSVGWAVITDEYKVPSKKFKVLGNTDRHSIKKNLIGAL

LFDSGETALATRLKRTARRRYTRRKNRICYLQEIFSNEMAKVDDSFFHRL

EESFLVEEDKKHERHPIFGNIVDEVAYHEKYPTIYHLRKKLVDSTDKADL

RLIYLALAHMIKFRGHFLIEGDLNPDNSDVDKLFIQLVQTYNQLFEENPI
```

-continued

NASGVDAKAILSARLSKSRRLENLIAQLPGEKKNGLFGNLIALSLGLTPN

FKSNFDLAEDAKLQLSKDTYDDDLDNLLAQIGDQYADLFLAAKNLSDAIL

LSDILRVNTEITKAPLSASMIKRYDEHHQDLTLLKALVRQQLPEKYKEIF

FDQSKNGYAGYIDGGASQLEFYKFIKPILEKMDGTEELLVKLNREDLLRK

QRTFDNGSIPHQIHLGELHAILRRQEDFYPFLKDNREKIEKILTFRIPYY

VGPLARGNSRFAWMTRKSEETITPWNFEEVVDKGASAQSFIERMTAFDKN

LPNEKVLPKHSLLYEYFTVYNELTKVKYVTEGMRKPAFLSGEQKKAIVDL

LFKTNRKVTVKQLKEDYFKKIECFDSVEISGVEDRFNASLGTYHDLLKII

KDKDFLDNEENEDILEDIVLTLTLFEDREMIEERLKTYAHLFDDKVMKQL

KRRRYTGWGALSRKLINGIRDKQSGKTILDFLKSDGFANRNFMALIHDDS

LTFKEDIQKAQVSGQGDSLHEHIANLAGSPAIKKGILQTVKVVDELVKVM

GRHKPENIVIEMARENQTTQKGQKNSRERMKRIEEGIKELGSQILKEHPV

ENTQLQNEKLYLYYLQNGRDMYVDQELDINRLSDYDVDHIVPQSFLKDDS

IDNKVLTRSDKNRGKSDNVPSEEVVKKMKNYWRQLLNAKLITQRKFDNLT

KAERGGLSELDKAGFIKRQLVETRAITKHVAQILDSRMNTKYDENDKLIR

EVKVITLKSKLVSDFRKDFQFYKVREINNYHHAHDAYLNAVVGTALIKKY

PKLESEFVYGDYKVYDVRKMIAKSEQEIGKATAKYFFYSNIMNFFKTEIT

LANGEIRKRPLIETNGETGEIVWDKGRDFATVRKVLSMPQVNIVKKTEVQ

TGGFSKESILPKRNSDKLIARKKDWDPKKYGGFDSPTVAYSVLVVAKVEK

GKSKKLKSVKELLGITIMERSSFEKNPIDFLEAKGYKEVKKDLIIKLPKY

SLFELENGRKRMLASAGELQKGNELALPSKYVNFLYLASHYEKLKGSPED

NEQKQLFVEQHKHYLDEIIEQISEFSKRVILADANLDKVLSAYNKHRDKP

IREQAENIIHLFTLTNLGAPAAFKYFDTTIDRKRYTSTKEVLDATLIHQS

ITGLYETRIDLSQLGGD

HF-BE3

(SEQ ID NO: 709)
MSSETGPVAVDPTLRRRIEPHEFEVFFDPRELRKETCLLYEINWGGRHSI

WRHTSQNTNKHVEVNFIEKFTTERYFCPNTRCSITWFLSWSPCGECSRAI

TEFLSRYPHVTLFIYIARLYHHADPRNRQGLRDLISSGVTIQIMTEQESG

YCWRNFVNYSPSNEAHWPRYPHLWVRLYVLELYCIILGLPPCLNILRRKQ

PQLTFFTIALQSCHYQRLPPHILWATGLKSGSETPGTSESATPESDKKYS

IGLAIGTNSVGWAVITDEYKVPSKKFKVLGNTDRHSIKKNLIGALLFDSG

ETAEATRLKRTARRRYTRRKNRICYLQEIFSNEMAKVDDSFFHRLEESFL

VEEDKKHERHPIFGNIVDEVAYHEKYPTIYHLRKKLVDSTDKADLRLIYL

ALAHMIKFRGHFLIEGDLNPDNSDVDKLFIQLVQTYNQLFEENPINASGV

DAKAILSARLSKSRRLENLIAQLPGEKKNGLFGNLIALSLGLTPNFKSNF

DLAEDAKLQLSKDTYDDDLDNLLAQIGDQYADLFLAAKNLSDAILLSDIL

RVNTEITKAPLSASMIKRYDEHHQDLTLLKALVRQQLPEKYKEIFFDQSK

NGYAGYIDGGASQEEFYKFIKPILEKMDGTEELLVKLNREDLLRKQRTFD

NGSIPHQIHLGELHAILRRQEDFYPFLKDNREKIEKILTFRIPYYVGPLA

RGNSRFAWMTRKSEETITPWNFEEVVDKGASAQSFIERMTAFDKNLPNEK

-continued

VLPKHSLLYEYFTVYNELTKVKYVTEGMRKPAFLSGEQKKAIVDLLFKTN

RKVTVKQLKEDYFKKIECFDSVEISGVEDRFNASLGTYHDLLKIIKDKDF

LDNEENEDILEDIVLTLTLFEDREMIEERLKTYAHLFDDKVMKQLKRRRY

TGWGALSRKLINGIRDKQSGKTILDFLKSDGFANRNFMALIHDDSLTFKE

DIQKAQVSGQGDSLHEHIANLAGSPAIKKGILQTVKVVDELVKVMGRHKP

ENIVIEMARENQTTQKGQKNSRERMKRIEEGIKELGSQILKEHPVENTQL

QNEKLYLYYLQNGRDMYVDQELDINRLSDYDVDHIVPQSFLKDDSIDNKV

LTRSDKNRGKSDNVPSEEVVKKMKNYWRQLLNAKLITQRKFDNLTKAERG

GLSELDKAGFIKRQLVETRAITKHVAQILDSRMNTKYDENDKLIREVKVI

TLKSKLVSDFRKDFQFYKVREINNYHHAHDAYLNAVVGTALIKKYPKLES

EFVYGDYKVYDVRKMIAKSEQEIGKATAKYFFYSNIMNFFKTEITLANGE

IRKRPLIETNGETGEIVWDKGRDFATVRKVLSMPQVNIVKKTEVQTGGFS

KESILPKRNSDKLIARKKDWDPKKYGGFDSPTVAYSVLVVAKVEKGKSKK

LKSVKELLGITIMERSSFEKNPIDFLEAKGYKEVKKDLIIKLPKYSLFEL

ENGRKRMLASAGELQKGNELALPSKYVNFLYLASHYEKLKGSPEDNEQKQ

LFVEQHKHYLDEIIEQISEFSKRVILADANLDKVLSAYNKHRDKPIREQA

ENIIHLFTLTNLGAPAAFKYFDTTIDRKRYTSTKEVLDATLIHQSITGLY

ETRIDLSQLGGD

Fusion Proteins Comprising Gam

Some aspects of the disclosure provide fusion proteins comprising a Gam protein. Some aspects of the disclosure provide base editors that further comprise a Gam protein. Base editors are known in the art and have been described previously, for example, in U.S. Patent Application Publication Nos.: U.S. 2015-0166980, published Jun. 18, 2015; U.S. 2015-0166981, published Jun. 18, 2015; U.S. 2015-0166984, published Jun. 18, 2015; U.S. 2015-01669851, published Jun. 18, 2015; U.S. 2016-0304846, published Oct. 20, 2016; U.S. 2017-0121693-A1, published May 4, 2017; and PCT Application publication Nos.: WO 2015089406, published Jun. 18, 2015; and WO2017070632, published Apr. 27, 2017; the entire contents of each of which are hereby incorporated by reference. A skilled artisan would understand, based on the disclosure, how to make and use base editors that further comprise a Gam protein.

In some embodiments, the disclosure provides fusion proteins comprising a guide nucleotide sequence-programmable DNA-binding protein and a Gam protein. In some embodiments, the disclosure provides fusion proteins comprising a cytidine deaminase domain and a Gam protein. In some embodiments, the disclosure provides fusion proteins comprising a UGI domain and a Gam protein. In some embodiments, the disclosure provides fusion proteins comprising a guide nucleotide sequence-programmable DNA-binding protein, a cytidine deaminase domain and a Gam protein. In some embodiments, the disclosure provides fusion proteins comprising a guide nucleotide sequence-programmable DNA-binding protein, a cytidine deaminase domain a Gam protein and a UGI domain.

In some embodiments, the Gam protein is a protein that binds to double strand breaks in DNA and prevents or inhibits degradation of the DNA at the double strand breaks. In some embodiments, the Gam protein is encoded by the bacteriophage Mu, which binds to double stranded breaks in DNA. Without wishing to be bound by any particular theory, Mu transposes itself between bacterial genomes and uses Gam to protect double stranded breaks in the transposition process. Gam can be used to block homologous recombination with sister chromosomes to repair double strand breaks, sometimes leading to cell death. The survival of cells exposed to UV is similar for cells expression Gam and cells where the recB is mutated. This indicates that Gam blocks DNA repair (Cox, 2013). The Gam protein can thus promote Cas9-mediated killing (Cui et al., 2016). GamGFP is used to label double stranded breaks, although this can be difficult in eukaryotic cells as the Gam protein competes with similar eukaryotic protein Ku (Shee et al., 2013).

Gam is related to Ku70 and Ku80, two eukaryotic proteins involved in non-homologous DNA end-joining (Cui et al., 2016). Gam has sequence homology with both subunits of Ku (Ku70 and Ku80), and can have a similar structure to the core DNA-binding region of Ku. Orthologs to Mu Gam are present in the bacterial genomes of *Haemophilus influenzae, Salmonella typhi, Neisseria meningitidis*, and the enterohemorrhagic O157:H7 strain of *E. coli* (d'Adda di Fagagna et al., 2003). Gam proteins have been described previously, for example, in COX, Proteins pinpoint double strand breaks. eLife. 2013; 2: e01561; Cui et al., Consequences of Cas9 cleavage in the chromosome of *Escherichia coli. Nucleic Acids Res.* 2016 May 19; 44(9):4243-51. doi: 10.1093/nar/gkw223. Epub 2016 Apr. 8; D'ADDA DI FAGAGNA et al., The Gam protein of bacteriophage Mu is an orthologue of eukaryotic Ku. EMBO Rep. 2003 January; 4(1):47-52; and SHEE et al., Engineered proteins detect spontaneous DNA breakage in human and bacterial cells. Elife. 2013 Oct. 29; 2:e01222. doi: 10.7554/eLife.01222; the contents of each of which are incorporated herein by reference.

In some embodiments, the Gam protein is a protein that binds double strand breaks in DNA and prevents or inhibits degradation of the DNA at the double strand breaks. In some embodiments, the Gam protein is a naturally occurring Gam protein from any organism (e.g., a bacterium), for example, any of the organisms provided herein. In some embodiments, the Gam protein is a variant of a naturally-occurring Gam protein from an organism. In some embodiments, the Gam protein does not occur in nature. In some embodiments, the Gam protein is at least 50%, at least 55%, at least 60%, at least 65%, at least 70%, at least 75% at least 80%, at least 85%, at least 90%, at least 95%, at least 96%, at least 97%, at least 98%, at least 99%, or at least 99.5% identical to a naturally-occurring Gam protein. In some embodiments, the Gam protein is at least 50%, at least 55%, at least 60%, at least 65%, at least 70%, at least 75% at least 80%, at least 85%, at least 90%, at least 95%, at least 96%, at least 97%, at least 98%, at least 99%, or at least 99.5% identical to any of the Gam proteins provided herein (e.g., SEQ ID NO: 9). Exemplary Gam proteins are provided below. In some embodiments, the Gam protein comprises any of the Gam proteins provided herein (e.g., SEQ ID NO: 710-734). In some embodiments, the Gam protein is a truncated version of any of the Gam proteins provided herein. In some embodiments, the truncated Gam protein is missing 1, 2, 3, 4, 5, 6, 7, 8, 9, 10, 11, 12, 13, 14, 15, 6, 17, 18, 19, or 20 N-terminal amino acid residues relative to a full-length Gam protein. In some embodiments, the truncated Gam protein may be missing 1, 2, 3, 4, 5, 6, 7, 8, 9, 10, 11, 12, 13, 14, 15, 6, 17, 18, 19, or 20 C-terminal amino acid residues relative to a full-length Gam protein. In some embodiments, the Gam protein does not comprise an N-terminal methionine.

In some embodiments, the Gam protein comprises an amino acid sequence that is at least 60%, at least 65%, at least 70%, at least 75%, at least 80%, at least 85%, at least 90%, at least 95, at least 98%, at least 99%, or at least 99.5% identical to any of the Gam proteins provided herein. In some embodiments, the Gam protein comprises an amino acid sequence that has 1, 2, 3, 4, 5, 6, 7, 8, 9, 10, 11, 12, 13, 14, 15, 16, 17, 18, 19, 20, 21, 22, 21, 24, 25, 26, 27, 28, 29, 30, 31, 32, 33, 34, 35, 36, 37, 38, 39, 40, 41, 42, 43, 44, 45, 46, 47, 48, 49, 50 or more mutations compared to any one of the Gam Proteins provided herein (e.g., SEQ ID NOs: 710-734). In some embodiments, the Gam protein comprises an amino acid sequence that has at least 5, at least 10, at least 15, at least 20, at least 25, at least 30, at least 35, at least 40, at least 45, at least 50, at least 60, at least 70, at least 80, at least 90, at least 100, at least 110, at least 120, at least 130, at least 140, at least 150, at least 160, or at least 170, identical contiguous amino acid residues as compared to any of the Gam proteins provided herein. In some embodiments, the Gam protein comprises the amino acid sequence of any of the Gam proteins provided herein. In some embodiments, the Gam protein consists of the any of the Gam proteins provided herein (e.g., SEQ ID NO: 710 or 711-734).

```
Gam form bacteriophage Mu
                                                                    (SEQ ID NO: 710)
AKPAKRIKSAAAAYVPQNRDAVITDIKRIGDLQREASRLETEMNDAIAEITEKFAARIAPI

KTDIETLSKGVQGWCEANRDELTNGGKVKTANLVTGDVSWRVRPPSVSIRGMDAVME

TLERLGLQRFIRTKQEINKEAILLEPKAVAGVAGITVKSGIEDFSIIPFEQEAGI

>WP_001107930.1 MULTISPECIES: host-nuclease inhibitor protein Gam [Enterobacteriaceae]
                                                                    (SEQ ID NO: 711)
MAKPAKRIKSAAAAYVPQNRDAVITDIKRIGDLQREASRLETEMNDAIAEITEKFAARIA

PIKTDIETLSKGVQGWCEANRDELTNGGKVKTANLVTGDVSWRVRPPSVSIRGMDAVM

ETLERLGLQRFIRTKQEINKEAILLEPKAVAGVAGITVKSGIEDFSIIPFEQEAGI

>CAA27978.1 unnamed protein product [Escherichia virus Mu]
                                                                    (SEQ ID NO: 712)
MAKPAKRIKSAAAAYVPQNRDAVITDIKRIGDLQREASRLETEMNDAIAEITEKFAARIA

PIKTDIETLSKGVQGWCEANRDELTNGGKVKTANLVTGDVSWRVRPPSVSIRGMDAVM

ETLERLGLQRFVRTKQEINKEAILLEPKAVAGVAGITVKSGIEDFSIIPFEQEAGI
```

-continued

>WP_001107932.1 host-nuclease inhibitor protein Gam [*Escherichia* coli]

(SEQ ID NO: 713)

MAKPAKRIKSAAAAYVPQNRDAVITDIKRIGDLQREASRLETEMNDAIAEITEKFAARIA

PLKTDIETLSKGVQGWCEANRDELTNGGKVKTANLVTGDVSWRVRPPSVSIRGMDAV

METLERLGLQRFIRTKQEINKEAILLEPKAVAGVAGITVKSGIEDFSIIPFEQEAGI

>WP_061335739.1 host-nuclease inhibitor protein Gam [*Escherichia* coli]

(SEQ ID NO: 714)

MAKPAKRIKSAAAAYVPQNRDAVITDIKRIGDLQREASRLETEMNDAIAEITEKFAARIA

PIKTDIETLSKGVQGWCEANRDELTNGGKVKTANLITGDVSWRVRPPSVSIRGMDAVM

ETLERLGLQRFIRTKQEINKEAILLEPKAVAGVAGITVKSGIEDFSIIPFEQEAGI

>WP_001107937.1 MULTISPECIES: host-nuclease inhibitor protein Gam [*Enterobacteriaceae*]
>EJL11163.1 bacteriophage Mu Gam like family protein [*Shigella sonnei* str. Moseley]
>CSO81529.1 host-nuclease inhibitor protein [*Shigella sonnei*] >OCE38605.1 host-nuclease
inhibitor protein Gam [*Shigella sonnei*] >SJK50067.1 host-nuclease inhibitor protein [*Shigella
sonnei*] >SJK19110.1 host-nuclease inhibitor protein [*Shigella sonnei*] >SIY81859.1 host-
nuclease inhibitor protein [*Shigella sonnei*] >SJJ34359.1 host-nuclease inhibitor protein
[*Shigella sonnei*] >SJK07688.1 host-nuclease inhibitor protein [*Shigella sonnei*]
host-nuclease inhibitor protein [*Shigella sonnei*] >SIY86865.1 host-nuclease inhibitor protein
[*Shigella sonnei*] >SJJ67303.1 host-nuclease inhibitor protein [*Shigella sonnei*] >SJJ18596.1
host-nuclease inhibitor protein [*Shigella sonnei*] >SIX52979.1 host-nuclease inhibitor protein
[*Shigella sonnei*] >SJD05143.1 host-nuclease inhibitor protein [*Shigella sonnei*] >SJD37118.1
host-nuclease inhibitor protein [*Shigella sonnei*] >SJE51616.1 host-nuclease inhibitor protein
[*Shigella sonnei*]

(SEQ ID NO: 715)

MAKPAKRIRNAAAAYVPQSRDAVVCDIRRIGDLQREAARLETEMNDAIAEITEKYASQI

APLKTSIETLSKGVQGWCEANRDELTNGGKVKTANLVTGDVSWRQRPPSVSIRGVDAV

METLERLGLQRFIRTKQEINKEAILLEPKAVAGVAGITVKSGIEDFSIIPFEQEAGI

>WP_089552732.1 host-nuclease inhibitor protein Gam [*Escherichia coli*]

(SEQ ID NO: 716)

MAKPAKRIKNAAAAYVPQSRDAVVCDIRRIGDLQREAARLETEMNDAIAEITEKYASQI

APLKTSIETISKGVQGWCEANRDELTNGGKVKTANLVTGDVSWRQRPPSVSIRGVDAV

METLERLGLQRFIRTKQEINKEAILLEPKAVAGVAGITVKSGIEDFSIIPFEQEAGI

>WP_042856719.1 host-nuclease inhibitor protein Gam [*Escherichia coli*] >CDL02915.1
putative host-nuclease inhibitor protein [*Escherichia coli* IS35]

(SEQ ID NO: 717)

MAKPAKRIKNAAAAYVPQSRDAVVCDIRRIGDLQREAARLETEMNDAIADITEKYASQI

APLKTSIETLSKGVQGWCEANRDELTNGGKVKTANLVTGDVSWRQRPPSVSIRGVDAV

METLERLGLQRFIRTKQEINKEAILLEPKAVAGVAGITVKSGIEDFSIIPFEQEAGI

>WP_001129704.1 host-nuclease inhibitor protein Gam [*Escherichia coli*] >EDU62392.1
bacteriophage Mu Gam like protein [*Escherichia coli* 53638]

(SEQ ID NO: 718)

MAKSAKRIRNAAAAYVPQSRDAVVCDIRRIGNLQREAARLETEMNDAIAEITEKFAARI

APLKTDIETLSKGVQGWCEANRDELTNGGKVKTANLVTGDVSWRQRPPSVSIRGVDAV

METLERLGLQRFIRTKQEINREAILLEPKAVAGVAGITVKSGIEDFSIIPFEQDAGI

>WP_001107936.1 MULTISPECIES: host-nuclease inhibitor protein Gam [*Enterobacteriaceae*]
>EGI94970.1 host-nuclease inhibitor protein gam [*Shigella boydii* 5216-82] >CSR34065.1 host-
nuclease inhibitor protein [*Shigella sonnei*] >CSQ65903.1 host-nuclease inhibitor protein
[*Shigella sonnei*] >CSQ94361.1 host-nuclease inhibitor protein [*Shigella sonnei*] >SJK23465.1
host-nuclease inhibitor protein [*Shigella sonnei*] >SJB59111.1 host-nuclease inhibitor protein
[*Shigella sonnei*] >SJI55768.1 host-nuclease inhibitor protein [*Shigella sonnei*] >SJI56601.1
host-nuclease inhibitor protein [*Shigella sonnei*] >SJJ20109.1 host-nuclease inhibitor protein
[*Shigella sonnei*] >SJJ54643.1 host-nuclease inhibitor protein [*Shigella sonnei*] >SJI29650.1
host-nuclease inhibitor protein [*Shigella sonnei*] >SIZ53226.1 host-nuclease inhibitor protein
[*Shigella sonnei*] >SJA65714.1 host-nuclease inhibitor protein [*Shigella sonnei*] >SJJ21793.1
host-nuclease inhibitor protein [*Shigella sonnei*] >SJD61405.1 host-nuclease inhibitor protein
[*Shigella sonnei*] >SJJ14326.1 host-nuclease inhibitor protein [*Shigella sonnei*] >SIZ57861.1
host-nuclease inhibitor protein [*Shigella sonnei*] >SJD58744.1 host-nuclease inhibitor protein
[*Shigella sonnei*] >SJD84738.1 host-nuclease inhibitor protein [*Shigella sonnei*] >SJJ51125.1
host-nuclease inhibitor protein [*Shigella sonnei*] >SJD01353.1 host-nuclease inhibitor protein
[*Shigella sonnei*] >SJE63176.1 host-nuclease inhibitor protein [*Shigella sonnei*]

-continued (SEQ ID NO: 719)
MAKPAKRIRNAAAAYVPQSRDAVVCDIRRIGDLQREAARLETEMNDAIAEITEKYASQI

APLKTSIETLSKGVQGWCEANRDELTNGGKVKTANLVTGDVSWRQRPPSVSIRGVDAV

METLERLGLQRFIRTKQEINKEAILLEPKAVAGVAGITVKSGIEDFSIIPFEQDAGI

>WP_050939550.1 host-nuclease inhibitor protein Gam [*Escherichia coli*] >KNF77791.1 host-nuclease inhibitor protein Gam [*Escherichia coli*]

(SEQ ID NO: 720)
MAKPAKRIKNAAAAYVPQSRDAVVCDIRRIGDLQREAARLETEMNDAIAEITEKYASQI

APLKTSIETLSKGVQGWCEANRDELTNGGKVKTANLVTGDVSWRLRPPSVSIRGVDAV

METLERLGLQRFICTKQEINKEAILLEPKVVAGVAGITVKSGIEDFSIIPFEQEAGI

>WP_085334715.1 host-nuclease inhibitor protein Gam [*Escherichia coli*] >OSC16757.1 host-nuclease inhibitor protein Gam [*Escherichia coli*]

(SEQ ID NO: 721)
MAKPVKRIRNAAAAYVPQSRDAVVCDIRRIGDLQREAARLETEMNDAIAEITEKYASQI

APLKTSIETLSKGIQGWCEANRDELTNGGKVKTANLVTGDVSWRQRPPSVSIRGVDAV

METLERLGLQRFIRTKQEINKEAILLEPKAVAGVAGITVKSGIEDFSIIPFEQEAGI

>WP_065226797.1 host-nuclease inhibitor protein Gam [*Escherichia coli*] >ANO88858.1 host-nuclease inhibitor protein Gam [*Escherichia coli*] >AN089006.1 host-nuclease inhibitor protein Gam [*Escherichia coli*]

(SEQ ID NO: 722)
MAKPAKRIRNAAAAYVPQSRDAVVCDIRWIGDLQREAVRLETEMNDAIAEITEKYASRI

APLKTRIETLSKGVQGWCEANRDELTNGGKVKTANLVTGDVSWRQRPPSVSIRGVDAV

METLERLGLQRFIRTKQEINKEAILLEPKAVAGVAGITVKSGIEDFSIIPFEQEAGI

>WP_032239699.1 host-nuclease inhibitor protein Gam [*Escherichia coli*] >KDU26235.1 bacteriophage Mu Gam like family protein [*Escherichia coli* 3-373-03 S4 C2] >KDU49057.1 bacteriophage Mu Gam like family protein [*Escherichia coli* 3-373-03 S4 C1] >KEL21581.1 bacteriophage Mu Gam like family protein [*Escherichia coli* 3-373-03 S4 C3]

(SEQ ID NO: 723)
MAKSAKRIRNAAATYVPQSRDAVVCDIRRIGDLQREAARLETEMNDAIAEITEKYASQI

APLKTSIETLSKGIQGWCEANRDELTNGGKVKTANLVTGDVSWRQRPPSVSIRGVDAV

METLERLGLQRFIRTKQEINKEAILLEPKAVAGVAGITVKSGIEDFSIIPFEQEAGI

>WP_080172138.1 host-nuclease inhibitor protein Gam [*Salmonella enterica*]

(SEQ ID NO: 724)
MAKSAKRIKSAAATYVPQSRDAVVCDIRRIGDLQREAARLETEMNDAIAEITEKYASQIA

PLKTSIETLSKGVQGWCEANRDELTNGGKVKSANLVTGDVQWRQRPPSVSIRGVDAVM

ETLERLGLQRFIRTKQEINKEAILLEPKAVAGVAGITVKSGIEDFSIlPFEQEAGI

>WP_077134654.1 host-nuclease inhibitor protein Gam [*Shigella sonnei*] >SIZ51898.1 host-nuclease inhibitor protein +Shigella sonnei+ >SJK07212.1 host-nuclease inhibitor protein [*Shigella sonnei*]

(SEQ ID NO: 725)
MAKSAKRIRNAAAAYVPQSRDAVVCDIRRIGNLQREAARLETEMNDAIAEITEKYASQI

APLKTSIETLSKGVQGWCEANRDELTNGGKVKTANLVTGDVSWRQRPPSVS1RGVDAV

METLERLGLQRFIRTKQEINKEAILLEPKAVAGVAGITVKSGIEDFSIIPFEQDAGI

>WP_000261565.1 host-nuclease inhibitor protein Gam [*Shigella flexneri*] >EGK20651.1 host-nuclease inhibitor protein gam [*Shigella flexneri* K-272] >EGK34753.1 host-nuclease inhibitor protein gam [*Shigella flexneri* K-227]

(SEQ ID NO: 726)
MVVSAIASTPHDAVVCDIRRIGDLQREAARLETEMNDAIAEITEKDASQIAPLKTSIETLS

KGVQGWCEANRDELTNGGKVKTANLVTGDVSWRQRPPSVS1RGVDAVMETLERLGLQ

RFIRTKQEINKEAILLEPKAVAGVAGITVKSGIEDFSIIPFEQEAGI

```
>ASG63807.1 host-nuclease inhibitor protein Gam [Kluyvera georgiana]
                                                                              (SEQ ID NO: 727)
MVSKPKRIKAAAANYVSQSRDAVITDIRKIGDLQREATRLESAMNDEIAVITEKYAGLIK

PLKADVEMLSKGVQGWCEANRDDLTSNGKVKTANLVTGDIQWRIRPPSVSVRGPDAV

METLTRLGLSRFIRTKQEINKEAILNEPLAVAGVAGITVKSGIEDFSIIPFEQTADI

>WP_078000363.1 host-nuclease inhibitor protein Gam [Edwardsiella tarda]
                                                                              (SEQ ID NO: 728)
MASKPKRIKSAAANYVSQSRDAVIIDIRKIGDLQREATRLESAMNDEIAVITEKYAGLIKP

LKADVEMLSKGVQGWCEANRDELTCNGKVKTANLVTGDIQWRIRPPSVSVRGPDSVM

ETLLRLGLSRFIRTKQEINKEAILNEPLAVAGVAGITVKTGVEDFSIIPFEQTADI

>WP_047389411.1 host-nuclease inhibitor protein Gam [Citrobacter freundii] >KGY86764.1
host-nuclease inhibitor protein Gam [Citrobacter freundii] >OIZ37450.1 host-nuclease inhibitor
protein Gam [Citrobacter freundii]
                                                                              (SEQ ID NO: 729)
MVSKPKRIKAAAANYVSQSKEAVIADIRKIGDLQREATRLESAMNDEIAVITEKYAGLIK

PLKTDVEILSKGVQGWCEANRDELTSNGKVKTANLVTGDIQWRIRPPSVAVRGPDAVM

ETLLRLGLSRHRTKQEINKEAILNEPLAVAGVAGITVKSGVEDFSIIPFEQTADI

>WP_058215121.1 host-nuclease inhibitor protein Gam [Salmonella enterica] >KSU39322.1
host-nuclease inhibitor protein Gam [Salmonella enterica subsp. enterica] >OHJ24376.1 host-
nuclease inhibitor protein Gam [Salmonella enterica] >ASG15950.1 host-nuclease inhibitor
protein Gam [Salmonella enterica subsp. enterica serovar Macclesfield str. S-1643]
                                                                              (SEQ ID NO: 730)
MASKPKRIKAAAALYVSQSREDVVRDIRMIGDFQREIVRLETEMNDQIAAVTLKYADKI

KPLQEQLKTLSEGVQNWCEANRSDLTNGGKVKTANLVTGDVQWRVRPPSVTVRGVDS

VMETLRRLGLSRFIRIKEEINKEAILNEPGAVAGVAGITVKSGVEDFSIIPFEQSATN

>WP_016533308.1 phage host-nuclease inhibitor protein Gam [Pasteurella multocida]
>EPE65165.1 phage host-nuclease inhibitor protein Gam [Pasteurella multocida P1933]
>ESQ71800.1 host-nuclease inhibitor protein Gam [Pasteurella multocida subsp. multocida
P1062] >ODS44103.1 host-nuclease inhibitor protein Gam [Pasteurella multocida]
>OPC87246.1 host-nuclease inhibitor protein Gam [Pasteurella multocida subsp. multocida]
>OPC98402.1 host-nuclease inhibitor protein Gam [Pasteurella multocida subsp. multocida]
                                                                              (SEQ ID NO: 731)
MAKKATRIKTTAQVYVPQSREDVASDIKTIGDLNREITRLETEMNDKIAEITESYKGQFSP

IQERIKNLSTGVQFWAEANRDQITNGGKTKTANLITGEVSWRVRNPSVKITGVDSVLQN

LKIHGLTKFIRVKEEINKEAILNEKHEVAGIAGIKVVSGVEDFVITPFEQEI

>WP_005577487.1 host-nuclease inhibitor protein Gam [Aggregatibacter
actinomycetemcomitans] >EHK90561.1 phage host-nuclease inhibitor protein Gam
[Aggregatibacter actinomycetemcomitans RhAA1] >KNE77613.1 host-nuclease inhibitor
protein Gam [Aggregatibacter actinomycetemcomitans RhAA1]
                                                                              (SEQ ID NO: 732)
MAKSATRVKATAQIYVPQTREDAAGDIKTIGDLNREVARLEAEMNDKIAAITEDYKDKF

APLQERIKTLSNGVQYWSEANRDQITNGGKTKTANLVTGEVSWRVRNPSVKVTGVDSV

LQNLRIHGLERFIRTKEEINKEAILNEKSAVAGIAGIKVITGVEDFVITPFEQEAA

>WP_090412521.1 host-nuclease inhibitor protein Gam [Nitrosomonas halophila]
>SDX89267.1 Mu-like prophage host-nuclease inhibitor protein Gam [Nitrosomonas halophila]
                                                                              (SEQ ID NO: 733)
MARNAARLKTKSIAYVPQSRDDAAADIRKIGDLQRQLTRTSTEMNDAIAAITQNFQPRM

DAIKEQINLLQAGVQGYCEAHRHALTDNGRVKTANLITGEVQWRQRPPSVSIRGQQVV

LETLRRLGLERFIRTKEEVNKEAILNEPDEVRGVAGLNVITGVEDFVITPFEQEQP

>WP_077926574.1 host-nuclease inhibitor protein Gam [Wohlfahrtiimonas larvae]
                                                                              (SEQ ID NO: 734)
MAKKRIKAAATVYVPQSKEEVQNDIREIGDISRKNERLETEMNDRIAEITNEYAPKFEVN

KVRLELLTKGVQSWCEANRDDLTNSGKVKSANLTGKVEWRQRPPSISVKGMDAVIE

WLQDSKYQRFLRTKVEVNKEAMLNEPEDAKTIPGITIKSGIEDFAITPFEQEAGV
```

Deaminase Domains

In some embodiments, the nucleobase editor useful in the present disclosure comprises: (i) a guide nucleotide sequence-programmable DNA-binding protein domain; and (ii) a deaminase domain. In certain embodiments, the deaminase domain of the fusion protein is a cytosine deaminase. In some embodiments, the deaminase is an APOBEC1 deaminase. In some embodiments, the deaminase is a rat APOBEC1. In some embodiments, the deaminase is a human APOBEC1. In some embodiments, the deaminase is an APOBEC2 deaminase. In some embodiments, the deaminase is an APOBEC3A deaminase. In some embodiments, the deaminase is an APOBEC3B deaminase. In some embodiments, the deaminase is an APOBEC3C deaminase. In some embodiments, the deaminase is an APOBEC3D deaminase. In some embodiments, is an APOBEC3F deaminase. In some embodiments, the deaminase is an APOBEC3G deaminase. In some embodiments, the deaminase is an APOBEC3H deaminase. In some embodiments, the deaminase is an APOBEC4 deaminase. In some embodiments, the deaminase is an activation-induced deaminase (AID). In some embodiments, the deaminase is a Lamprey CDA1 (pmCDA1). In some embodiments, the deaminase is a human APOBEC3G or a functional fragment thereof. In some embodiments, the deaminase is an APOBEC3G variant comprising mutations correspond to the D316R/D317R mutations in the human APOBEC3G. Exemplary, non-limiting cytosine deaminase sequences that may be used in accordance with the methods of the present disclosure are provided in Example 1 below.

In some embodiments, the cytosine deaminase is a wild type deaminase or a deaminase as set forth in SEQ ID NOs: 1-260, 270-292, 315-323, 680, or 682. In some embodiments, the cytosine deaminase domains of the fusion proteins provided herein include fragments of deaminases and proteins homologous to either a deaminase or a deaminase fragment. For example, in some embodiments, a deaminase domain may comprise a fragment of the amino acid sequence set forth in any of SEQ ID NOs: 1-260, 270-292, 315-323, 680, or 682. In some embodiments, a deaminase domain comprises an amino acid sequence homologous to the amino acid sequence set forth in any of SEQ ID NOs: 1-260, 270-292, 315-323, 680, or 682, or an amino acid sequence homologous to a fragment of the amino acid sequence set forth in any of SEQ ID NOs: 1-260, 270-292, 315-323, 680, or 682. In some embodiments, proteins comprising a deaminase, a fragment of a deaminase, or a homolog of a deaminase are referred to as "deaminase variants." A deaminase variant shares homology to a deaminase, or a fragment thereof. For example a deaminase variant is at least about 70% identical, at least about 80% identical, at least about 90% identical, at least about 95% identical, at least about 96% identical, at least about 97% identical, at least about 98% identical, at least about 99% identical, at least about 99.5% identical, or at least about 99.9% identical to a wild type deaminase or a deaminase as set forth in any of SEQ ID NOs: 1-260, 270-292, or 315-323. In some embodiments, the deaminase variant comprises a fragment of the deaminase, such that the fragment is at least about 70% identical, at least about 80% identical, at least about 90% identical, at least about 95% identical, at least about 96% identical, at least about 97% identical, at least about 98% identical, at least about 99% identical, at least about 99.5% identical, or at least about 99.9% identical to the corresponding fragment of wild type deaminase or a deaminase as set forth in any of SEQ ID NOs: 1-260, 270-292, 315-323, 680, or 682. In some embodiments, the cytosine deaminase is at least at least about 70% identical, at least about 80% identical, at least about 90% identical, at least about 95% identical, at least about 96% identical, at least about 97% identical, at least about 98% identical, at least about 99% identical, at least about 99.5% identical, or at least about 99.9% identical to an APOBEC3G variant as set forth in SEQ ID NO: 291 or SEQ ID NO: 292, and comprises mutations corresponding to the D316E/D317R mutations in SEQ ID NO: 290.

In some embodiments, the cytosine deaminase domain is fused to the N-terminus of the guide nucleotide sequence-programmable DNA-binding protein domain. For example, the fusion protein may have an architecture of $NH_2$-[cytosine deaminase]-[guide nucleotide sequence-programmable DNA-binding protein domain]-COOH. The "-" used in the general architecture above indicates the presence of an optional linker. The term "linker," as used herein, refers to a chemical group or a molecule linking two molecules or moieties, e.g., two domains of a fusion protein, such as, for example, a dCas9 domain and a cytosine deaminase domain. Typically, the linker is positioned between, or flanked by, two groups, molecules, or other moieties and connected to each one via a covalent bond, thus connecting the two. In some embodiments, the linker is an amino acid or a plurality of amino acids (e.g., a peptide or protein). In some embodiments, the linker is an organic molecule, group, polymer, or chemical moiety. In some embodiments, the linker is 5-100 amino acids in length, for example, 5, 6, 7, 8, 9, 10, 11, 12, 13, 14, 15, 16, 17, 18, 19, 20, 21, 22, 23, 24, 25, 26, 27, 28, 29, 30, 30-35, 35-40, 40-45, 45-50, 50-60, 60-70, 70-80, 80-90, 90-100, 100-150, or 150-200 amino acids in length. Longer or shorter linkers are also contemplated. Linkers may be of any form known in the art. For example, the linker may be a linker from a website, such as www[dot]ibi[dot]vu[dot]nl/programs/linkerdbwww/or from www[dot]ibi[dot]vu[dot]nl/programs/linkerdbwww/src/database.txt. The linkers may also be unstructured, structured, helical, or extended.

In some embodiments, the cytosine deaminase domain and the Cas9 domain are fused to each other via a linker. Various linker lengths and flexibilities between the deaminase domain (e.g., APOBEC1) and the Cas9 domain can be employed (e.g., ranging from flexible linkers of the form $(GGGS)_n$ (SEQ ID NO: 303), $(GGGGS)_n$ (SEQ ID NO: 304), $(GGS)_n$ and $(G)_n$ to more rigid linkers of the form $(EAAAK)_n$ (SEQ ID NO: 305, SGSETPGTSESATPES (SEQ ID NO: 306) (see, e.g., Guilinger et al., *Nat. Biotechnol.* 2014; 32(6): 577-82; the entire contents of which is incorporated herein by reference), $(XP)_n$, or a combination of any of these, wherein X is any amino acid, and n is independently an integer between 1 and 30, in order to achieve the optimal length for deaminase activity for the specific application. In some embodiments, n is independently 1, 2, 3, 4, 5, 6, 7, 8, 9, 10, 11, 12, 13, 14, 15, 16, 17, 18, 19, 20, 21, 22, 23, 24, 25, 26, 27, 28, 29, or 30, or, if more than one linker or more than one linker motif is present, any combination thereof. In some embodiments, the linker comprises a $(GGS)_n$ motif, wherein n is 1, 2, 3, 4, 5, 6, 7, 8, 9, 10, 11, 12, 13, 14 or 15. In some embodiments, the linker comprises a $(GGS)_n$ motif, wherein n is 1, 3, or 7. In some embodiments, the linker comprises the amino acid sequence SGSETPGTSESATPES (SEQ ID NO: 306), also referred to as the XTEN linker. In some embodiments, the linker comprises an amino acid sequence chosen from the group including, but not limited to, AGVF (SEQ ID NO: 307), GFLG (SEQ ID NO: 308), FK, AL, ALAL (SEQ ID NO: 349), and ALALA (SEQ ID NO: 309). In some embodiments, suitable linker motifs and configurations include those described in Chen et al., Fusion protein linkers: property, design and functionality. *Adv Drug Deliv Rev.* 2013; 65(10):1357-69, which is incorporated herein by reference. In some embodiments, the linker may comprise any of the following amino acid sequences: VPFLLEPDN-INGKTC (SEQ ID NO: 350), GSAGSAAGSGEF (SEQ ID NO: 351), SIVAQLSRPDPA (SEQ ID NO: 352), MKI-IEQLPSA (SEQ ID NO: 353), VRHKLKRVGS (SEQ ID NO: 354), GHGTGSTGSGSS (SEQ ID NO: 355), MSRP-DPA (SEQ ID NO: 356), GSAGSAAGSGEF (SEQ ID NO: 357), SGSETPGTSESA (SEQ ID NO: 358), SGSETPGT-SESATPEGGSGGS (SEQ ID NO: 359), and GGSM (SEQ ID NO: 360). Additional suitable linker sequences will be apparent to those of skill in the art based on the instant disclosure.

Figure 4:
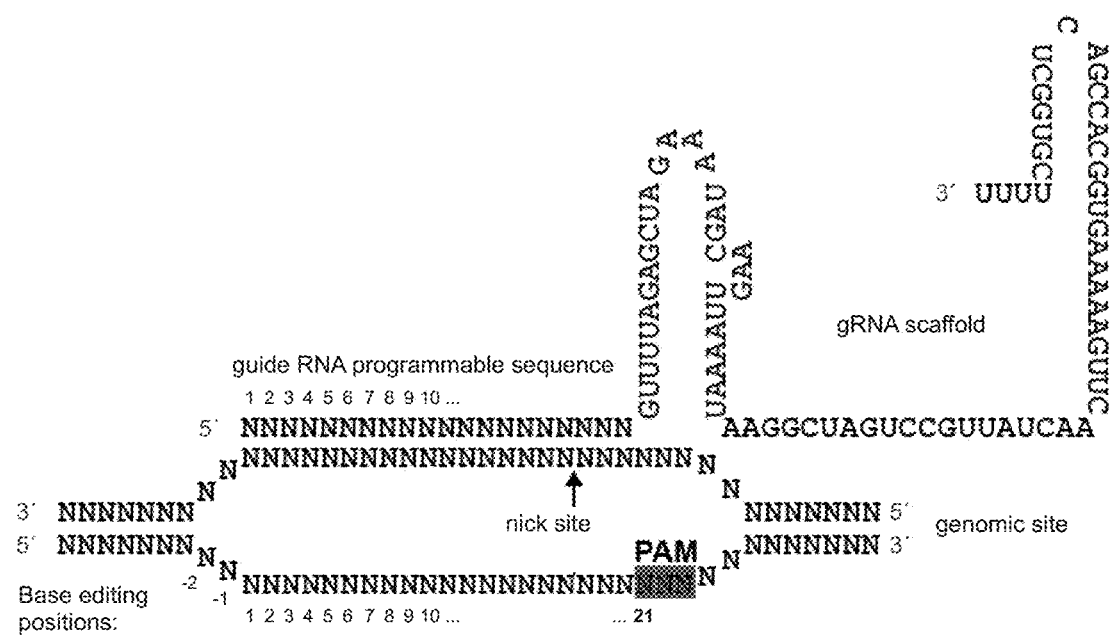

To successfully edit the desired target C base, the linker between Cas9 and APOBEC may be optimized, as described in Komor et al., *Nature,* 533, 420-424 (2016), which is incorporated herein by reference. The numbering scheme for base editing is based on the predicted location of the target C within the single stranded stretch of DNA (R-loop) displaced by a programmable guide RNA sequence occurring when a DNA-binding domain (e.g. Cas9, nCas9, dCas9) binds a genomic site (see FIG. 4). Conveniently, the sequence immediately surrounding the target C also matches the sequence of the guide RNA, which may be used as a reference as done in the Tables herein. The numbering scheme for base editing is based on a standard 20-mer programmable sequence, and defines position "21" as the first DNA base of the PAM sequence, resulting in position "1" assigned to the first DNA base matching the 5'-end of the 20-mer programmable guide RNA sequence. Therefore, for all Cas9 variants, position "21" is defined as the first base of the PAM sequence (e.g. NGG, NGAN, NGNG, NGAG, NGCG, NNGRRT, NGRRN, NNNRRT, NNNGATT, NNA-GAA, NAAAC). When a longer programmable guide RNA sequence is used (e.g. 21-mer) the 5'-end bases are assigned a decreasing negative number starting at "−1". For other DNA-binding domains that differ in the position of the PAM sequence, or that require no PAM sequence, the programmable guide RNA sequence is used as a reference for numbering. A 3-aa linker gives a 2-5 base editing window (e.g., positions 2, 3, 4, or 5 relative to the PAM sequence in positions 20-23). A 9-aa linker gives a 3-6 base editing window (e.g., positions 3, 4, 5, or 6 relative to the PAM sequence at position 21). A 16-aa linker (e.g., the SGSET-PGTSESATPES (SEQ ID NO: 306) linker) gives a 4-7 base editing window (e.g., positions 4, 5, 6, or 7 relative to the PAM sequence at position 21). A 21-aa linker gives a 5-8 base editing window (e.g., positions 5, 6, 7, 8 relative to the PAM sequence at position 21). Each of these windows can be useful for editing different targeted C bases. For example, the targeted C bases may be at different distances from the adjacent PAM sequence, and by varying the linker length, the precise editing of the desired C base is ensured. One skilled in the art, based on the teachings of CRISPR/Cas9 technology, in particular the teachings of U.S. Provisional Applications, 62/245,828, 62/279,346, 62/311,763, 62/322, 178, 62/357,352, 62/370,700, and 62/398,490, and in Komor et al., *Nature,* "Programmable editing of a target base in genomic DNA without double-stranded DNA cleavage," 533, 420-424 (2016), each of which is incorporated herein by reference, will be able to determine the editing window for his/her purpose, and properly design the linker of the cytosine deaminase-dCas9 protein for the precise targeting of the desired C base. To successfully edit the desired target C base, the sequence identity of the homolog of Cas9 attached to APOBEC may be optimized based on the teachings of CRISPR/Cas9 technology. As a non-limiting example, the teachings of any of the following documents may be used: U.S. Provisional Application Nos. 62/245,828, 62/279,346, 62/311,763, 62/322,178, 62/357,352, 62/370, 700, and 62/398,490, and Komor et al., *Nature,* 533, 420-424 (2016), each of which is incorporated herein by reference in its entirety. APOBEC1-XTEN-SaCas9n-UGI gives a 1-12 base editing window (e.g., positions 1, 2, 3, 4, 5, 6, 7, 8, 9, 10, 11, or 12 relative to the NNNRRT PAM sequence in positions 20-26). One skilled in the art, based on the teachings of CRISPR/Cas9 technology, will be able to determine the editing window for his/her purpose, and properly determine the required Cas9 homolog and linker attached to the cytosine deaminase for the precise targeting of the desired C base.

In some embodiments, the fusion protein useful in the present disclosure further comprises a uracil glycosylase inhibitor (UGI) domain. A "uracil glycosylase inhibitor" refers to a protein that inhibits the activity of uracil-DNA glycosylase. The C to T base change induced by deamination results in a U:G heteroduplex, which triggers a cellular DNA-repair response. Uracil DNA glycosylase (UDG) catalyzes removal of U from DNA in cells and initiates base excision repair, with reversion of the U:G pair to a C:G pair as the most common outcome. Thus, such cellular DNA-repair response may be responsible for the decrease in nucleobase editing efficiency in cells. Uracil DNA Glycosylase Inhibitor (UGI) is known in the art to potently blocks human UDG activity. As described in Komor et al., *Nature* (2016), fusing a UGI domain to the cytidine deaminase-dCas9 fusion protein reduced the activity of UDG and significantly enhanced editing efficiency.

Suitable UGI protein and nucleotide sequences are provided herein and additional suitable UGI sequences are known to those in the art, and include, for example, those published in Wang et al., Uracil-DNA glycosylase inhibitor gene of bacteriophage PBS2 encodes a binding protein specific for uracil-DNA glycosylase. *J. Biol. Chem.* 264: 1163-1171(1989); Lundquist et al., Site-directed mutagenesis and characterization of uracil-DNA glycosylase inhibitor protein. Role of specific carboxylic amino acids in complex formation with *Escherichia coli* uracil-DNA glycosylase. *J. Biol. Chem.* 272:21408-21419(1997); Ravishankar et al., X-ray analysis of a complex of *Escherichia coli* uracil DNA glycosylase (EcUDG) with a proteinaceous inhibitor. The structure elucidation of a prokaryotic UDG. *Nucleic Acids Res.* 26:4880-4887(1998); and Putnam et al., Protein mimicry of DNA from crystal structures of the uracil-DNA glycosylase inhibitor protein and its complex with *Escherichia coli* uracil-DNA glycosylase. *J. Mol. Biol.* 287:331-346(1999), each of which is incorporated herein by reference. In some embodiments, the UGI comprises the following amino acid sequence:

```
Bacillus phage PBS2 (Bacteriophage PBS2)Uracil-
DNA glycosylase inhibitor
                                    (SEQ ID NO: 361)
MTNLSDIIEKETGKQLVIQESILMLPEEVEEVIGNKPESDILVHTAYDE

STDENVMLLTSDAPEYKPWALVIQDSNGENKIKML
```

In some embodiments, the UGI protein comprises a wild type UGI or a UGI as set forth in SEQ ID NO: 361. In some embodiments, the UGI proteins useful in the present disclosure include fragments of UGI and proteins homologous to a UGI or a UGI fragment. For example, in some embodiments, a UGI comprises a fragment of the amino acid sequence set forth in SEQ ID NO: 361. In some embodiments, a UGI comprises an amino acid sequence homologous to the amino acid sequence set forth in SEQ ID NO: 361 or an amino acid sequence homologous to a fragment of the amino acid sequence set forth in SEQ ID NO: 361. In some embodiments, proteins comprising UGI or fragments of UGI or homologs of either UGI or UGI fragments are referred to as "UGI variants." A UGI variant shares homology with UGI, or a fragment thereof. For example, a UGI variant is at least about 70% identical, at least about 80% identical, at least about 85% identical, at least about 90% identical, at least about 95% identical, at least about 96% identical, at least about 97% identical, at least about 98% identical, at least about 99% identical, at least about 99.5% identical, or at least about 99.9% identical to a wild type UGI or a UGI as set forth in SEQ ID NO: 361. In some embodiments, the UGI variant comprises a fragment of UGI, such that the fragment is at least about 70% identical, at least about 80% identical, at least about 90% identical, at least about 95% identical, at least about 96% identical, at least about 97% identical, at least about 98% identical, at least about 99% identical, at least about 99.5% identical, or at least about 99.9% identical to the corresponding fragment of wild type UGI or a UGI as set forth in SEQ ID NO: 361.

It should be appreciated that additional proteins may be uracil glycosylase inhibitors. For example, other proteins that are capable of inhibiting (e.g., sterically blocking) a uracil-DNA glycosylase base-excision repair enzyme are within the scope of this disclosure. In some embodiments, a uracil glycosylase inhibitor is a protein that binds DNA. In some embodiments, a uracil glycosylase inhibitor is a protein that binds single-stranded DNA. For example, a uracil glycosylase inhibitor may be a *Erwinia tasmaniensis* single-stranded binding protein. In some embodiments, the single-stranded binding protein comprises the amino acid sequence (SEQ ID NO: 362). In some embodiments, a uracil glycosylase inhibitor is a protein that binds uracil. In some embodiments, a uracil glycosylase inhibitor is a protein that binds uracil in DNA. In some embodiments, a uracil glycosylase inhibitor is a catalytically inactive uracil DNA-glycosylase protein. In some embodiments, a uracil glycosylase inhibitor is a catalytically inactive uracil DNA-glycosylase protein that does not excise uracil from the DNA. For example, a uracil glycosylase inhibitor is a UdgX. In some embodiments, the UdgX comprises the amino acid sequence (SEQ ID NO: 363). As another example, a uracil glycosylase inhibitor is a catalytically inactive UDG. In some embodiments, a catalytically inactive UDG comprises the amino acid sequence (SEQ ID NO: 364). It should be appreciated that other uracil glycosylase inhibitors would be apparent to the skilled artisan and are within the scope of this disclosure. In some embodiments, the fusion protein comprises a guide nucleotide sequence-programmable DNA-binding protein, a cytidine deaminase domain, a Gam protein, and a UGI domain. In some embodiments, any of the fusion proteins provided herein that comprise a guide nucleotide sequence-programmable DNA-binding protein (e.g., a Cas9 domain), a cytidine deaminase, and a Gam protein may be further fused to a UGI domain either directly or via a linker. This disclosure also contemplates a fusion protein comprising a Cas9 nickase-nucleic acid editing domain fused to a cytidine deaminase and a Gam protein, which is further fused to a UGI domain.

*Erwinia tasmaniensis* SSB (themostable single-stranded DNA binding protein)
(SEQ ID NO: 362)
MASRGVNKVILVGNLGQDPEVRYMPNGGAVANITLATSESWRDKQTGETKE

KTEWHRVVLFGKLAEVAGEYLRKGSQVYIEGALQTRKWTDQAGVEKYTTEV

VVNVGGTMQMLGGRSQGGGASAGGQNGGSNNGWGQPQQPQGGNQFSGGAQQ

QARPQQQPQQNNAPANNEPP1DFDDDIP

UdgX (binds to Uracil in DNA but does not excise)
(SEQ ID NO: 363)
MAGAQDFVPHTADLAELAAAAGECRGCGLYRDATQAVFGAGGRSARIMMIG

EQPGDKEDLAGLPFVGPAGRLLDRALEAADIDRDALYVTNAVKHFKFTRAA

GGKRRIHKTPSRTEVVACRPWLIAEMTSVEPDVVVLLGATAAKALLGNDFR

VTQHRGEVLHVDDVPGDPALVATVHPSSLLRGPKEERESAFAGLVDDLRVA

ADVRP

UDG (catalytically inactive human UDG, binds to Uracil in DNA but does not excise)
(SEQ ID NO: 364)
MIGQKTLYSFFSPSPARKRHAPSPEPAVQGTGVAGVPEESGDAAAIPAKKA

PAGQEEPGTPPSSPLSAEQLDRIQRNKAAALLRLAARNVPVGFGESWKKHL

SGEFGKPYFIKLMGFVAEERKHYTVYPPPHQVFTWTQMCDIKDVKVVILGQ

EPYHGPNQAHGLCFSVQRPVPPPPSLENIYKELSTDIEDFVHPGHGDLSGW

AKQGVLLLNAVLTVRAHQANSHKERGWEQFTDAVVSWLNQNSNGLVFLLWG

SYAQKKGSAIDRKRHHVLQTAHPSPLSVYRGFFGCRHFSKTNELLQKSGKK

PIDWKEL

In some embodiments, the UGI domain is fused to the C-terminus of the dCas9 domain in the fusion protein. Thus, the fusion protein would have an architecture of NH$_2$-[cytosine deaminase]-[guide nucleotide sequence-programmable DNA-binding protein domain]-[UGI]-COOH. In some embodiments, the UGI domain is fused to the N-terminus of the cytosine deaminase domain. As such, the fusion protein would have an architecture of NH$_2$-[UGI]-[cytosine deaminase]-[guide nucleotide sequence-programmable DNA-binding protein domain]-COOH. In some embodiments, the UGI domain is fused between the guide nucleotide sequence-programmable DNA-binding protein domain and the cytosine deaminase domain. As such, the fusion protein would have an architecture of NH$_2$-[cytosine deaminase]-[UGI]-[guide nucleotide sequence-programmable DNA-binding protein domain]-COOH. The linker sequences described herein may also be used for the fusion of the UGI domain to the cytosine deaminase-dCas9 fusion proteins.

In some embodiments, the fusion protein comprises the structure: [cytosine deaminase]-[optional linker sequence]-[guide nucleotide sequence-programmable DNA binding protein]-[optional linker sequence]-[UGI]; [cytosine deaminase]-[optional linker sequence]-[UGI]-[optional linker sequence]-[guide nucleotide sequence-programmable DNA binding protein]; [UGI]-[optional linker sequence]-[cytosine deaminase]-[optional linker sequence]-[guide nucleotide sequence-programmable DNA binding protein]; [UGI]-[optional linker sequence]-[guide nucleotide sequence-programmable DNA binding protein]-[optional linker sequence]-[cytosine deaminase]; [guide nucleotide sequence-programmable DNA binding protein]-[optional linker sequence]-[cytosine deaminase]-[optional linker sequence]-[UGI]; or [guide nucleotide sequence-programmable DNA binding protein]-[optional linker sequence]-[UGI]-[optional linker sequence]-[cytosine deaminase].

In some embodiments, the fusion protein is of the structure: [cytosine deaminase]-[optional linker sequence]-[Cas9 nickase]-[optional linker sequence]-[UGI]; [cytosine deaminase]-[optional linker sequence]-[UGI]-[optional linker sequence]-[Cas9 nickase]; [UGI]-[optional linker sequence]-[cytosine deaminase]-[optional linker sequence]-[Cas9 nickase]; [UGI]-[optional linker sequence]-[Cas9 nickase]-[optional linker sequence]-[cytosine deaminase]; [Cas9 nickase]-[optional linker sequence]-[cytosine deaminase]-[optional linker sequence]-[UGI]; or [Cas9 nickase]-[optional linker sequence]-[UGI]-[optional linker sequence]-[cytosine deaminase].

In some embodiments, fusion proteins provided herein further comprise a nuclear localization sequence (NLS). In some embodiments, the NLS is fused to the N-terminus of the fusion protein. In some embodiments, the NLS is fused to the C-terminus of the fusion protein. In some embodiments, the NLS is fused to the N-terminus of the UGI protein. In some embodiments, the NLS is fused to the C-terminus of the UGI protein. In some embodiments, the NLS is fused to the N-terminus of the guide nucleotide sequence-programmable DNA-binding protein domain. In some embodiments, the NLS is fused to the C-terminus of the guide nucleotide sequence-programmable DNA-binding protein domain. In some embodiments, the NLS is fused to the N-terminus of the cytosine deaminase. In some embodiments, the NLS is fused to the C-terminus of the deaminase. In some embodiments, the NLS is fused to the fusion protein via one or more linkers. In some embodiments, the NLS is fused to the fusion protein without a linker. Non-limiting, exemplary NLS sequences may be PKKKRKV (SEQ ID NO: 365) or MDSLLMNRRKFLYQFKNVRWAKGRRETYLC (SEQ ID NO: 366).

Some aspects of the present disclosure provide nucleobase editors described herein associated with a guide nucleotide sequence (e.g., a guide RNA or gRNA). gRNAs can exist as a complex of two or more RNAs, or as a single RNA molecule. gRNAs that exist as a single RNA molecule may be referred to as single-guide RNAs (sgRNAs), though "gRNA" is used interchangeably to refer to guide RNAs that exist as either single molecules or as a complex of two or more molecules. Typically, gRNAs that exist as a single RNA species comprise two domains: (1) a domain that shares homology to a target nucleic acid (e.g., and directs binding of the Cas9 complex to the target); and (2) a domain that binds the Cas9 protein. In some embodiments, domain (2) corresponds to a sequence known as a tracrRNA, and comprises a stem-loop structure. For example, in some embodiments, domain (2) is identical or homologous to a tracrRNA as provided in Jinek et al., *Science* 337:816-821 (2012), which is incorporated herein by reference. Other examples of gRNAs (e.g., those including domain 2) can be found in U.S. Provisional Patent Application, U.S. Ser. No. 61/874,682, filed Sep. 6, 2013, entitled "Switchable Cas9 Nucleases And Uses Thereof," and U.S. Provisional Patent Application, U.S. Ser. No. 61/874,746, filed Sep. 6, 2013, entitled "Delivery System For Functional Nucleases," each are hereby incorporated by reference in their entirety. The gRNA comprises a nucleotide sequence that complements a target site, which mediates binding of the nuclease/RNA complex to said target site, providing the sequence specificity of the nuclease:RNA complex. These proteins are able to be targeted, in principle, to any sequence specified by the guide RNA. Methods of using RNA-programmable nucleases, such as Cas9, for site-specific cleavage (e.g., to modify a genome) are known in the art (see e.g., Cong, L. et al. *Science* 339, 819-823 (2013); Mali, P. et al. *Science* 339, 823-826 (2013); Hwang, W. Y. et al. *Nature Biotechnology* 31, 227-229 (2013); Jinek, M. et al. *eLife* 2, e00471 (2013); Dicarlo, J. E. et al. *Nucleic acids research* (2013); Jiang, W. et al. *Nature Biotechnology* 31, 233-239 (2013); the entire contents of each of which are incorporated herein by reference). In particular, examples of guide nucleotide sequences (e.g., sgRNAs) that may be used to target the fusion protein of the present disclosure to its target sequence to deaminate the targeted C bases are described in Komor et al., *Nature*, 533, 420-424 (2016), which is incorporated herein by reference.

The specific structure of the guide nucleotide sequences (e.g., sgRNAs) depends on its target sequence and the relative distance of a PAM sequence downstream of the target sequence. One skilled in the art will understand, that no unifying structure of guide nucleotide sequence is given, because the target sequences are different for each and every C targeted to be deaminated.

However, the present disclosure provides guidance in how to design the guide nucleotide sequence, e.g., an sgRNA, so that one skilled in the art may use such teachings to design these for a target sequence of interest. A gRNA typically comprises a tracrRNA framework allowing for Cas9 binding, and a guide sequence, which confers sequence specificity to fusion proteins disclosed herein to target the CCR5 gene. In some embodiments, the guide RNA comprises a structure 5'-[guide sequence]-tracrRNA-3'. Non-limiting, exemplary tracrRNA sequences are shown in Table 10. The tracrRNA sequence may vary from the presented sequences.

TABLE 10

| TracrRNA othologues and sequences | | |
|---|---|---|
| Organism | tracrRNA sequence | SEQ ID NO: |
| C. jejuni | AAGAAAUUUAAAAAGGGACUAAAAUAAAGAGUUUGCGGGACUCUGCGGGGUUACAAUCCCCUAAAACCGCUUUU | 367 |
| F. novicida | AUCUAAAAUUAUAAAUGUACCAAAUAAUUAAUGCUCUGUAAUCAUUUAAAAGUAUUUUGAACGGACCUCUGUUUGACACGUCUGAAUAACUAAAA | 368 |
| S. thermophilus2 | UGUAAGGGACGCCUUACACAGUUACUUAAAUCUUGCAGAAGCUACAAAGAUAAGGCUUCAUGCCGAAAUCAACACCCUGUCAUUUUAUGGCAGGGUGUUUUCGUUAUUU | 369 |

TABLE 10-continued

TracrRNA otholoques and sequences

| Organism | tracrRNA sequence | SEQ ID NO: |
|---|---|---|
| M. mobile | UGUAUUUCGAAAUACAGAUGUACAGUUAAGAAUACAU AAGAAUGAUACAUCACUAAAAAAAGGCUUUAUGCCGU AACUACUACUUAUUUUCAAAAUAAGUAGUUUUUUUU | 370 |
| L. innocua | AUUGUUAGUAUUCAAAAUAACAUAGCAAGUUAAAAUA AGGCUUUGUCCGUUAUCAACUUUUAAUUAAGUAGCGC UGUUUCGGCGCUUUUUUU | 371 |
| S. pyogenes | GUUGGAACCAUUCAAAACAGCAUAGCAAGUUAAAAUA AGGCUAGUCCGUUAUCAACUUGAAAAAGUGGCACCGA GUCGGUGCUUUUUUU | 372 |
| S. mutans | GUUGGAAUCAUUCGAAACAACACAGCAAGUUAAAAUA AGGCAGUGAUUUUUAAUCCAGUCCGUACACAACUUGA AAAAGUGCGCACCGAUUCGUGCUUUUUUAUUU | 373 |
| S. thermophilus | UUGUGGUUUGAAACCAUUCGAAACAACACAGCGAGUU AAAAUAAGGCUUAGUCCGUACUCAACUUGAAAAGGUG GCACCGAUUCGGUGUUUUUUUU | 374 |
| N. meningitidis | ACAUAUUGUCGCACUGCGAAAUGAGAACCGUUGCUAC AAUAAGGCCGUCUGAAAAGAUGUGCCGCAACGCUCUG CCCCUUAAAGCUUCUGCUUUAAGGGGCA | 375 |
| P. multocida | GCAUAUUGUUGCACUGCGAAAUGAGAGACGUUGCUAC AAUAAGGCUUCUGAAAAGAAUGACCGUAACGCUCUGC CCCUUGUGAUUCUUAAUUGCAAGGGGCAUCGUUUUU | 376 |
| S. pyogenes | GUUUAAGAGCUAUGCUGGAAAGCCACGGUGAAAAAGU UCAACUAUUGCCUGAUCGGAAUAAAAUUUGAACGAUAC GACAGUCGGUGCUUUUUUU | 377 |
| S. pyogenes | GUUUAAGAGCUAGAAAUAGCAAGUUUAAAUAAGGCUA GUCCGUUAUCAACUUGAAAAAGUGGCACCGAGUCGGU GCUUUUUU | 378 |
| S. thermophilus CRISPR1 | GUUUUUGUACUCUCAAGAUUCAAUAAUCUUGCAGAAG CUACAAAGAUAAGGCUUCAUGCCGAAAUCAACACCCU GUCAUUUUAUGGCAGGGUGUUUU | 379 |
| S. thermophilus CRISPR3 | GUUUUAGAGCUGUGUUGUUUGUUAAAACAACACAGCG AGUUAAAAUAAGGCUUAGUCCGUACUCAACUUGAAAA GGUGGCACCGAUUCGGUGUUUUU | 380 |

The guide sequence of the gRNA comprises a sequence that is complementary to the target sequence. The guide sequence is typically about 20 nucleotides long. For example, the guide sequence may be 15-25 nucleotides long. In some embodiments, the guide sequence is 15, 16, 17, 18, 19, 20, 21, 22, 23, 24, or 25 nucleotides long. In some embodiments, the guide sequence is more than 25 nucleotides long. Such suitable guide RNA sequences typically comprise guide sequences that are complementary to a nucleic sequence within 50 nucleotides upstream or downstream of the target nucleotide to be edited.

In some embodiments, the guide RNA is about 15-100 nucleotides long and comprises a sequence of at least 10 contiguous nucleotides that is complementary to a target sequence. In some embodiments, the guide RNA is 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, or 50 nucleotides long. In some embodiments, the guide RNA comprises a sequence of 15, 16, 17, 18, 19, 20, 21, 22, 23, 24, 25, 26, 27, 28, 29, 30, 31, 32, 33, 34, 35, 36, 37, 38, 39, or 40 contiguous nucleotides that is complementary to a target sequence.

Compositions

Aspects of the present disclosure relate to compositions that may be used for editing CCR5-encoding polynucleotides, CCR2-encoding polynucleotides, or both CCR5-encoding polynucleotides and CCR2-encoding polynucleotides. In some embodiments, the editing is carried out in vitro. In some embodiments, the editing is carried out in a cultured cell. In some embodiments, the editing is carried out in vivo. In some embodiments, the editing is carried out in a mammal. In some embodiments, the mammal is a human. In some embodiments, the mammal may be a rodent. In some embodiments, the editing is carried out ex vivo.

In some embodiments, the composition comprises: (i) a fusion protein comprising: (a) a guide nucleotide sequence-programmable DNA binding protein domain; and (b) a cytosine deaminase domain; and (ii) a guide nucleotide sequence targeting the fusion protein of (i) to a polynucleotide encoding a C—C chemokine receptor type 5 (CCR5) protein.

In some embodiments, the composition comprises: (i) a fusion protein comprising: (a) a guide nucleotide sequence-programmable DNA binding protein domain; and (b) a cytosine deaminase domain; (ii) a guide nucleotide sequence targeting the fusion protein of (i) to a polynucleotide encoding a C—C chemokine receptor type 2 (CCR2) protein.

In some embodiments, the composition comprises: (i) a fusion protein comprising: (a) a guide nucleotide sequence-programmable DNA binding protein domain; and (b) a cytosine deaminase domain; (ii) a guide nucleotide sequence targeting the fusion protein of (i) to a polynucleotide encoding a C—C chemokine receptor type 5 (CCR5) protein; (iii) a guide nucleotide sequence targeting the fusion protein of (i) to a polynucleotide encoding a C—C chemokine receptor type 2 (CCR2) protein.

The guide nucleotide sequence used in the compositions described herein for editing the CCR5-encoding polynucleotide is selected from SEQ ID NOs: 381-657. In some embodiments, the composition comprises a nucleic acid encoding a fusion protein described herein and a guide nucleotide sequence described herein. In some embodiments, the composition described herein further comprises a pharmaceutically acceptable carrier. In some embodiments, the nucleobase editor (i.e., the fusion protein) and the gRNA are provided in two different compositions.

As used here, the term "pharmaceutically-acceptable carrier" means a pharmaceutically-acceptable material, composition or vehicle, such as a liquid or solid filler, diluent, excipient, manufacturing aid (e.g., lubricant, talc magnesium, calcium or zinc stearate, or steric acid), or solvent encapsulating material, involved in carrying or transporting the compound from one site (e.g., the delivery site) of the body to another site (e.g., organ, tissue or portion of the body). A pharmaceutically acceptable carrier is "acceptable" in the sense of being compatible with the other ingredients of the formulation and not injurious to the tissue of the subject (e.g., physiologically compatible, sterile, having physiologic pH, etc.). Some examples of materials which can serve as pharmaceutically-acceptable carriers include: (1) sugars, such as lactose, glucose and sucrose; (2) starches, such as corn starch and potato starch; (3) cellulose, and its derivatives, such as sodium carboxymethyl cellulose, methylcellulose, ethyl cellulose, microcrystalline cellulose, and cellulose acetate; (4) powdered tragacanth; (5) malt; (6) gelatin; (7) lubricating agents, such as magnesium stearate, sodium lauryl sulfate, and talc; (8) excipients, such as cocoa butter and suppository waxes; (9) oils, such as peanut oil, cottonseed oil, safflower oil, sesame oil, olive oil, corn oil, and soybean oil; (10) glycols, such as propylene glycol; (11) polyols, such as glycerin, sorbitol, mannitol, and polyethylene glycol (PEG); (12) esters, such as ethyl oleate and ethyl laurate; (13) agar; (14) buffering agents, such as magnesium hydroxide and aluminum hydroxide; (15) alginic acid; (16) pyrogen-free water; (17) isotonic saline; (18) Ringer's solution; (19) ethyl alcohol; (20) pH buffered solutions; (21) polyesters, polycarbonates and/or polyanhydrides; (22) bulking agents, such as polypeptides and amino acids (23) serum component, such as serum albumin, HDL and LDL; (22) $C_2$-$C_{12}$ alcohols, such as ethanol; and (23) other non-toxic compatible substances employed in pharmaceutical formulations. Wetting agents, coloring agents, release agents, coating agents, sweetening agents, flavoring agents, perfuming agents, preservatives, and antioxidants can also be present in the formulation. The terms such as "excipient," "carrier," "pharmaceutically acceptable carrier," or the like are used interchangeably herein.

In some embodiments, the nucleobase editors and the guide nucleotides in a composition of the present disclosure are administered by injection, by means of a catheter, by means of a suppository, or by means of an implant, the implant being of a porous, non-porous, or gelatinous material, including a membrane, such as a sialastic membrane, or a fiber. In some embodiments, the nucleobase editors and the guide nucleotides in a composition of the present disclosure are administered by injection into the bloodstream.

In other embodiments, the nucleobase editors and the guide nucleotides are delivered in a controlled release system. In one embodiment, a pump may be used (see, e.g., Langer, 1990, Science 249:1527-1533; Sefton, 1989, CRC Crit. Ref. Biomed. Eng. 14:201; Buchwald et al., 1980, Surgery 88:507; Saudek et al., 1989, N. Engl. J. Med. 321:574, the entire contents of each of which are incorporated herein by reference). In another embodiment, polymeric materials can be used (See, e.g., Medical Applications of Controlled Release (Langer and Wise eds., CRC Press, Boca Raton, Fla., 1974); Controlled Drug Bioavailability, Drug Product Design and Performance (Smolen and Ball eds., Wiley, New York, 1984); Ranger and Peppas, 1983, Macromol. Sci. Rev. Macromol. Chem. 23:61; See also: Levy et al., 1985, Science 228:190; During et al., 1989, Ann. Neurol. 25:351; Howard et al., 1989, J. Neurosurg. 71:105, each of which is incorporated herein by reference). Other controlled release systems are discussed, for example, in Langer, supra.

In typical embodiments, the pharmaceutical composition is formulated in accordance with routine procedures as a pharmaceutical composition adapted for intravenous or subcutaneous administration to a subject, e.g., a human. Typically, compositions for administration by injection are solutions in sterile isotonic aqueous buffer. Where necessary, the pharmaceutical can also include a solubilizing agent and a local anesthetic such as lignocaine to ease pain at the site of the injection. Generally, the ingredients are supplied either separately or mixed together in a unit dosage form, for example, as a dry lyophilized powder or water free concentrate in a hermetically sealed container such as an ampoule or sachette indicating the quantity of active agent. Where the pharmaceutical is to be administered by infusion, it can be dispensed with an infusion bottle containing sterile pharmaceutical grade water or saline. Where the pharmaceutical is administered by injection, an ampoule of sterile water for injection or saline can be provided so that the ingredients can be mixed prior to administration.

A pharmaceutical composition for systemic administration may be a liquid, e.g., sterile saline, lactated Ringer's or Hank's solution. In addition, the pharmaceutical composition can be in solid forms and re-dissolved or suspended immediately prior to use. Lyophilized forms are also contemplated.

The pharmaceutical composition can be contained within a lipid particle or vesicle, such as a liposome or microcrystal, which is also suitable for parenteral administration. The particles can be of any suitable structure, such as unilamellar or plurilamellar, so long as compositions are contained therein. Compounds can be entrapped in 'stabilized plasmid-lipid particles' (SPLP) containing the fusogenic lipid dioleoylphosphatidylethanolamine (DOPE), low levels (5-10 mol %) of cationic lipid, and stabilized by a polyethyleneglycol (PEG) coating (Zhang Y. P. et al., Gene Ther. 1999, 6:1438-47, the entire contents of which is incorporated herein by reference). Positively charged lipids such as N-[1-(2,3-dioleoyloxi)propyl]-N,N,N-trimethyl-amonium-methylsulfate, or "DOTAP," are particularly preferred for such particles and vesicles. The preparation of such lipid particles is well known. See, e.g., U.S. Pat. Nos. 4,880,635; 4,906,477; 4,911,928; 4,917,951; 4,920,016; and 4,921,757, each of which is incorporated herein by reference.

The pharmaceutical compositions of this disclosure may be administered or packaged as a unit dose, for example. The term "unit dose" when used in reference to a pharmaceutical composition of the present disclosure refers to physically discrete units suitable as unitary dosage for the subject, each unit containing a predetermined quantity of active material calculated to produce the desired therapeutic effect in association with the required diluent; i.e., carrier, or vehicle.

In some embodiments, the nucleobase editors or the guide nucleotides described herein may be conjugated to a therapeutic moiety, e.g., an anti-inflammatory agent. Techniques for conjugating such therapeutic moieties to polypeptides, including e.g., Fc domains, are well known; see, e.g., Amon et al., "Monoclonal Antibodies For Immunotargeting Of Drugs In Cancer Therapy", in Monoclonal Antibodies And Cancer Therapy, Reisfeld et al. (eds.), 1985, pp. 243-56, Alan R. Liss, Inc.); Hellstrom et al., "Antibodies For Drug Delivery", in Controlled Drug Delivery (2nd Ed.), Robinson et al. (eds.), 1987, pp. 623-53, Marcel Dekker, Inc.); Thorpe, "Antibody Carriers Of Cytotoxic Agents In Cancer Therapy: A Review", in Monoclonal Antibodies '84: Biological And Clinical Applications, Pinchera et al. (eds.), 1985, pp. 475-506); "Analysis, Results, And Future Prospective Of The Therapeutic Use Of Radiolabeled Antibody In Cancer Therapy", in Monoclonal Antibodies For Cancer Detection And Therapy, Baldwin et al. (eds.), 1985, pp. 303-16, Academic Press; and Thorpe et al. (1982) "The Preparation And Cytotoxic Properties Of Antibody-Toxin Conjugates," Immunol. Rev., 62:119-158; each of which is incorporated herein by reference.

Further, the compositions of the present disclosure may be assembled into kits. In some embodiments, the kit comprises nucleic acid vectors for the expression of the nucleobase editors described herein. In some embodiments, the kit further comprises appropriate guide nucleotide sequences (e.g., gRNAs) or nucleic acid vectors for the expression of such guide nucleotide sequences, to target the nucleobase editors to the desired target sequence.

The kit described herein may include one or more containers housing components for performing the methods described herein and optionally instructions of uses. Any of the kit described herein may further comprise components needed for performing the assay methods. Each component of the kits, where applicable, may be provided in liquid form (e.g., in solution), or in solid form, (e.g., a dry powder). In certain cases, some of the components may be reconstitutable or otherwise processable (e.g., to an active form), for example, by the addition of a suitable solvent or other species (for example, water or certain organic solvents), which may or may not be provided with the kit.

In some embodiments, the kits may optionally include instructions and/or promotion for use of the components provided. As used herein, "instructions" can define a component of instruction and/or promotion, and typically involve written instructions on or associated with packaging of the disclosure. Instructions also can include any oral or electronic instructions provided in any manner such that a user will clearly recognize that the instructions are to be associated with the kit, for example, audiovisual (e.g., videotape, DVD, etc.), Internet, and/or web-based communications, etc. The written instructions may be in a form prescribed by a governmental agency regulating the manufacture, use, or sale of pharmaceuticals or biological products, which can also reflect approval by the agency of manufacture, use or sale for animal administration. As used herein, "promoted" includes all methods of doing business including methods of education, hospital and other clinical instruction, scientific inquiry, drug discovery or development, academic research, pharmaceutical industry activity including pharmaceutical sales, and any advertising or other promotional activity including written, oral and electronic communication of any form, associated with the disclosure. Additionally, the kits may include other components depending on the specific application, as described herein.

The kits may contain any one or more of the components described herein in one or more containers. The components may be prepared sterilely, packaged in a syringe, and shipped refrigerated. Alternatively it may be housed in a vial or other container for storage. A second container may have other components prepared sterilely. Alternatively the kits may include the active agents premixed and shipped in a vial, tube, or other container.

The kits may have a variety of forms, such as a blister pouch, a shrink wrapped pouch, a vacuum sealable pouch, a sealable thermoformed tray, or a similar pouch or tray form, with the accessories loosely packed within the pouch, one or more tubes, containers, a box or a bag. The kits may be sterilized after the accessories are added, thereby allowing the individual accessories in the container to be otherwise unwrapped. The kits can be sterilized using any appropriate sterilization techniques, such as radiation sterilization, heat sterilization, or other sterilization methods known in the art. The kits may also include other components, depending on the specific application, for example, containers, cell media, salts, buffers, reagents, syringes, needles, a fabric such as gauze, for applying or removing a disinfecting agent, disposable gloves, a support for the agents prior to administration, etc.

Therapeutics

The compositions and kits described herein may be administered to a subject in need thereof, in a therapeutically effective amount, to prevent or treat conditions related to HIV infection and/or AIDS. The compositions and kits are effective in preventing or treating HIV infection in the subject or reducing the potential for HIV infection in the subject (including prevention of HIV infection in a subject).

"A therapeutically effective amount" as used herein refers to the amount of each therapeutic agent of the present disclosure required to confer therapeutic effect on the subject, either alone or in combination with one or more other therapeutic agents. Effective amounts vary, as recognized by those skilled in the art, depending on the particular condition being treated, the severity of the condition, the individual subject parameters including age, physical condition, size, gender and weight, the duration of the treatment, the nature of concurrent therapy (if any), the specific route of administration and like factors within the knowledge and expertise of the health practitioner. These factors are well known to those of ordinary skill in the art and can be addressed with no more than routine experimentation. It is generally preferred that a maximum dose of the individual components or combinations thereof be used, that is, the highest safe dose according to sound medical judgment. It will be understood by those of ordinary skill in the art, however, that a subject may insist upon a lower dose or tolerable dose for medical reasons, psychological reasons or for virtually any other reasons. Empirical considerations, such as the half-life, generally will contribute to the determination of the dosage. For example, therapeutic agents that are compatible with the human immune system, such as polypeptides comprising regions from humanized antibodies or fully human antibodies, may be used to prolong the half-life of the polypeptide and to prevent the polypeptide being attacked by the host's immune system.

Frequency of administration may be determined and adjusted over the course of therapy, and is generally, but not necessarily, based on treatment and/or suppression and/or amelioration and/or delay of a disease. Alternatively, sustained continuous release formulations of a polypeptide or a polynucleotide (e.g., RNA or DNA) may be appropriate. Various formulations and devices for achieving sustained release are known in the art. In some embodiments, dosage is daily, every other day, every three days, every four days, every five days, or every six days. In some embodiments, dosing frequency is once every week, every 2 weeks, every 4 weeks, every 5 weeks, every 6 weeks, every 7 weeks, every 8 weeks, every 9 weeks, or every 10 weeks; or once every month, every 2 months, or every 3 months, or longer. The progress of this therapy is easily monitored by conventional techniques and assays.

The dosing regimen (including the polypeptide or the polynucleotide used) can vary over time. In some embodiments, for an adult subject of normal weight, doses ranging from about 0.01 to 1000 mg/kg may be administered. In some embodiments, the dose is between 1 to 200 mg. The particular dosage regimen, i.e., dose, timing and repetition, will depend on the particular subject and that subject's medical history, as well as the properties of the polypeptide or the polynucleotide (such as the half-life of the polypeptide or the polynucleotide, and other considerations well known in the art).

For the purpose of the present disclosure, the appropriate dosage of a therapeutic agent as described herein will depend on the specific agent (or compositions thereof) employed, the formulation and route of administration, the type and severity of the disease, whether the polypeptide or the polynucleotide is administered for preventive or therapeutic purposes, previous therapy, the subject's clinical history and response to the antagonist, and the discretion of the attending physician. Typically the clinician will administer a polypeptide or a polynucleotide until a dosage is reached that achieves the desired result.

Administration of one or more polypeptides or polynucleotides can be continuous or intermittent, depending, for example, upon the recipient's physiological condition, whether the purpose of the administration is therapeutic or prophylactic, and other factors known to skilled practitioners. The administration of a polypeptide or a polynucleotide may be essentially continuous over a preselected period of time or may be in a series of spaced dose, e.g., either before, during, or after developing a disease. As used herein, the term "treating" refers to the application or administration of a polypeptide or a polynucleotide or composition including the polypeptide or the polynucleotide to a subject in need thereof. As used herein, "treating" a disease includes preventing disease onset, e.g., preventing HIV infection and/or preventing the onset of AIDS.

"A subject in need thereof" refers to an individual who has a disease, a symptom of the disease, or a predisposition or susceptibility toward the disease, with the purpose to prevent, cure, heal, alleviate, relieve, alter, remedy, ameliorate, improve, or affect the disease, one or more symptoms of the disease, or predisposition toward the disease. In some embodiments, the subject is at risk of becoming infected with HIV. In some embodiments, the subject is infected with HIV. In some embodiments, the subject has AIDS. In some embodiments, the subject is a mammal. In some embodiments, the subject is a non-human primate. In some embodiments, the subject is human. Alleviating a disease includes delaying the development or progression of the disease (i.e., AIDS), or reducing disease severity. Alleviating the disease does not necessarily require curative results.

As used therein, "delaying" the development of a disease means to defer, hinder, slow, retard, stabilize, and/or postpone progression of the disease. This delay can be of varying lengths of time, depending on the history of the disease and/or individuals being treated. A method that "delays" or alleviates the development of a disease, or delays the onset of the disease, is a method that reduces probability of developing one or more symptoms of the disease in a given time frame and/or reduces extent of the symptoms in a given time frame, when compared to not using the method. Such comparisons are typically based on clinical studies, using a number of subjects sufficient to give a statistically significant result.

"Development" or "progression" of a disease means initial manifestations and/or ensuing progression of the disease. Development of the disease can be detectable and assessed using standard clinical techniques as well known in the art. However, development also refers to progression that may be undetectable. For purpose of this disclosure, development or progression refers to the biological course of the symptoms. "Development" includes occurrence, recurrence, and onset.

As used herein "onset" or "occurrence" of a disease includes initial onset and/or recurrence. Conventional methods, known to those of ordinary skill in the art of medicine, can be used to administer the isolated polypeptide or pharmaceutical composition to the subject, depending upon the type of disease to be treated or the site of the disease. This composition can also be administered via other conventional routes, e.g., administered orally, parenterally, by inhalation spray, topically, rectally, nasally, buccally, vaginally, or via an implanted reservoir.

The term "parenteral," as used herein, includes subcutaneous, intracutaneous, intravenous, intramuscular, intraarticular, intraarterial, intrasynovial, intrasternal, intrathecal, intralesional, and intracranial injection or infusion techniques. In addition, the compositions described herein can be administered to the subject via injectable depot routes of administration such as using 1-, 3-, or 6-month depot injectable or biodegradable materials and methods.

Host Cells and Organisms

Other aspects of the present disclosure provide host cells and organisms for the production and/or isolation of the nucleobase editors, e.g., for in vitro editing. Host cells are genetically engineered to express the nucleobase editors and components of the translation system described herein. In some embodiments, host cells comprise vectors encoding the nucleobase editors and components of the translation system (e.g., transformed, transduced, or transfected), which can be, for example, a cloning vector or an expression vector. The vector can be, for example, in the form of a plasmid, a bacterium, a virus, a naked polynucleotide, or a conjugated polynucleotide. The vectors are introduced into cells and/or microorganisms by standard methods including electroporation, infection by viral vectors, high velocity ballistic penetration by small particles with the nucleic acid either within the matrix of small beads or particles, or on the surface (Klein et al., *Nature* 327, 70-73 (1987), which is incorporated herein by reference). In some embodiments, the host cell is a prokaryotic cell. In some embodiments, the host cell is a eukaryotic cell. In some embodiments, the host cell is a bacterial cell. In some embodiments, the host cell is a yeast cell. In some embodiments, the host cell is a mammalian cell. In some embodiments, the host cell is a human cell. In some embodiments, the host cell is a cultured cell. In some embodiments, the host cell is within a tissue or an organism.

The engineered host cells can be cultured in conventional nutrient media modified as appropriate for such activities as, for example, screening steps, activating promoters or selecting transformants. These cells can optionally be cultured into transgenic organisms.

Several well-known methods of introducing target nucleic acids into bacterial cells are available, any of which can be used in the present disclosure. These include: fusion of the recipient cells with bacterial protoplasts containing the DNA, electroporation, projectile bombardment, and infection with viral vectors (discussed further, below), etc. Bacterial cells can be used to amplify the number of plasmids containing DNA constructs of the present disclosure. The bacteria are grown to log phase and the plasmids within the bacteria can be isolated by a variety of methods known in the art (see, for instance, Sambrook). In addition, a plethora of kits are commercially available for the purification of plasmids from bacteria, (see, e.g., EasyPrep™, FlexiPrep™, both from Pharmacia Biotech; StrataClean™, from Stratagene; and, QIAprep™ from Qiagen). The isolated and purified plasmids are then further manipulated to produce other plasmids, used to transfect cells or incorporated into related vectors to infect organisms. Typical vectors contain transcription and translation terminators, transcription and translation initiation sequences, and promoters useful for regulation of the expression of the particular target nucleic acid. The vectors optionally comprise generic expression cassettes containing at least one independent terminator sequence, sequences permitting replication of the cassette in eukaryotes, or prokaryotes, or both, (e.g., shuttle vectors) and selection markers for both prokaryotic and eukaryotic systems. Vectors are suitable for replication and integration in prokaryotes, eukaryotes, or preferably both. See, Giliman & Smith, Gene 8:81 (1979); Roberts, et al., *Nature*, 328:731 (1987); and Schneider, B., et al., *Protein Expr. Purifi* 6435: 10 (1995)), the entire contents of each of which are incorporated herein by reference.

Bacteriophages useful for cloning is provided, e.g., by the ATCC, e.g., The ATCC Catalogue of Bacteria and Bacteriophage (1992) Gherna et al. (eds) published by the ATCC. Additional basic procedures for sequencing, cloning and other aspects of molecular biology and underlying theoretical considerations are also found in Watson et al. (1992) Recombinant DNA Second Edition Scientific American Books, NY, the entire contents of which is incorporated herein by reference.

Other useful references, e.g., for cell isolation and culture (e.g., for subsequent nucleic acid isolation) include Freshney (1994) Culture of Animal Cells, a Manual of Basic Technique, third edition, Wiley-Liss, New York and the references cited therein; Payne et al. (1992) Plant Cell and Tissue Culture in Liquid Systems John Wiley & Sons, Inc. New York, N.Y.; Gamborg and Phillips (eds) (1995) Plant Cell. Tissue and Organ Culture; Fundamental Methods Springer Lab Manual, Springer-Verlag (Berlin Heidelberg N.Y.) and Atlas and Parks (eds) The Handbook of Microbiological Media (1993) CRC Press, Boca Raton, Fla., the entire contents of each of which are incorporated herein by reference. In addition, essentially any nucleic acid (and virtually any labeled nucleic acid, whether standard or non-standard) can be custom or standard ordered from any of a variety of commercial sources, such as The Midland Certified Reagent Company (mcrc@oligos.com), The Great American Gene Company (www.genco.com), ExpressGen Inc. (www.expressgen.com), Operon Technologies Inc. (Alameda, Calif.), and many others.

Without further elaboration, it is believed that one skilled in the art can, based on the above description, utilize the present disclosure to its fullest extent. The following specific embodiments are, therefore, to be construed as merely illustrative, and not limitative of the remainder of the disclosure in any way whatsoever. All publications cited herein are incorporated by reference for the purposes or subject matter referenced herein.

EXAMPLES

In order that the compositions and methods described herein may be more fully understood, the following examples are set forth. The synthetic examples described in this application are offered to illustrate the compounds and methods provided herein and are not to be construed in any way as limiting their scope.

Example 1: Guide Nucleotide Sequence-Programmable DNA-Binding Protein Domains, Deaminases, and Base Editors Non-limiting examples of suitable guide nucleotide sequence-programmable DNA-binding protein domains are provided. The disclosure provides Cas9 variants, for example, Cas9 proteins from one or more organisms, which may comprise one or more mutations (e.g., to generate dCas9 or Cas9 nickase). In some embodiments, one or more of the amino acid residues, identified below by an asterisk, of a Cas9 protein may be mutated. In some embodiments, the D10 and/or H840 residues of the amino acid sequence provided in SEQ ID NO: 1, or a corresponding mutation in any of the amino acid sequences provided in SEQ ID NOs: 11-260, are mutated. In some embodiments, the D10 residue of the amino acid sequence provided in SEQ ID NO: 1, or a corresponding mutation in any of the amino acid sequences provided in SEQ ID NOs: 11-260, is mutated to any amino acid residue, except for D. In some embodiments, the D10 residue of the amino acid sequence provided in SEQ ID NO: 1, or a corresponding mutation in any of the amino acid sequences provided in SEQ ID NOs: 11-260, is mutated to an A. In some embodiments, the H840 residue of the amino acid sequence provided in SEQ ID NO: 1, or a corresponding residue in any of the amino acid sequences provided in SEQ ID NOs: 11-260, is an H. In some embodiments, the H840 residue of the amino acid sequence provided in SEQ ID NO: 1, or a corresponding mutation in any of the amino acid sequences provided in SEQ ID NOs: 11-260, is mutated to any amino acid residue, except for H. In some embodiments, the H840 residue of the amino acid sequence provided in SEQ ID NO: 1, or a corresponding mutation in any of the amino acid sequences provided in SEQ ID NOs: 11-260, is mutated to an A. In some embodiments, the D10 residue of the amino acid sequence provided in SEQ ID NO: 1, or a corresponding residue in any of the amino acid sequences provided in SEQ ID NOs: 11-260, is a D.

A number of Cas9 sequences from various species were aligned to determine whether corresponding homologous amino acid residues of D10 and H840 of SEQ ID NO: 1 or SEQ ID NO: 11 can be identified in other Cas9 proteins, allowing the generation of Cas9 variants with corresponding mutations of the homologous amino acid residues. The alignment was carried out using the NCBI Constraint-based Multiple Alignment Tool (COBALT (accessible at st-va.ncbi.nlm.nih.gov/tools/cobalt), with the following parameters. Alignment parameters: Gap penalties −11, −1; End-Gap penalties −5, −1. CDD Parameters: Use RPS BLAST on; Blast E-value 0.003; Find Conserved columns and Recompute on. Query Clustering Parameters: Use query clusters on; Word Size 4; Max cluster distance 0.8; Alphabet Regular.

An exemplary alignment of four Cas9 sequences is provided below. The Cas9 sequences in the alignment are: Sequence 1 (S1): SEQ ID NO: 11|WP_0109222511 gi 499224711|type II CRISPR RNA-guided endonuclease Cas9 [*Streptococcus pyogenes*]; Sequence 2 (S2): SEQ ID NO: 12|WP_039695303|gi 746743737|type II CRISPR RNA-guided endonuclease Cas9 [*Streptococcus gallolyticus*]; Sequence 3 (S3): SEQ ID NO: 13|WP_045635197|gi 782887988|type II CRISPR RNA-guided endonuclease Cas9 [*Streptococcus mitis*]; Sequence 4 (S4): SEQ ID NO: 14|5AXW_A|gi 924443546|*Staphylococcus aureus* Cas9. The HNH domain (bold and underlined) and the RuvC domain (boxed) are identified for each of the four sequences. Amino acid residues 10 and 840 in S1 and the homologous amino acids in the aligned sequences are identified with an asterisk following the respective amino acid residue.

```
S1    1    --MDKK-YSIGLD*IGTNSVGWAVITDEYKVPSKKFKVLGNTDRHSIKKNLI--GALLFDSG--ETAEATRLKRTARRRYT    73

S2    1    --MTKKNYSIGLD*IGTNSVGWAVITDDYKVPAKKMKVLGNTDKKYIKKNLL--GALLFDSG--ETAEATRLKRTARRRYT    74

S3    1    --M-KKGYSIGLD*IGTNSVGFAVITDDYKVPSKKMKVLGNTDKRFIKKNLI--GALLFDEG--TTAEARRLKRTARRRYT    73

S4    1    GSHMKRNYILGLD*IGITSVGYGII--DYET----------------RDVIDAGVRLFKEANVENNEGRRSKRGARRLKR   61

S1    74   RRKNRICYLQEIFSNEMAKVDDSFFHRLEESFLVEEDKKHERHPIFGNIVDEVAYHEKYPTIYHLRKKLVDSTDKADLRL   153

S2    75   RRKNRLRYLQEIFANEIAKVDESFFQRLDESFLTDDDKTFDSHPIFGNKAEEDAYHQKFPTIYHLRKHLADSSEKADLRL   154

S3    74   RRKNRLRYLQEIFSEEMSKVDSSFFHRLDDSFLIPEDKRESKYPIFATLTEEKEYHKQFPTIYHLRKQLADSKEKTDLRL   153

S4    62   RRRHRIQRVKKLL-------------FDYNLLTD------------------HSELSGINPYEARVKGLSQKLSEEE    107

S1    154  IYLALAHMIKFRGHFLIEGDLNPDNSDVDKLFIQLVQTYNQLFEENPINASGVDAKAILSARLSKSRRLENLIAQLPGEK   233

S2    155  VYLALAHMIKFRGHFLIEGELNAENTDVQKIFADFVGVYNRTFDDSHLSEITVDVASILTEKISKSRRLENLIKYYPTEK   234

S3    154  IYLALAHMIKYRGHFLYEEAFDIKNNDIQKIFNEFISIYDNTFEGSSLSGQNAQVEAIFTDKISKSAKRERVLKLFPDEK   233

S4    108  FSAALLHLAKRRG--------------------VHNVNEVEEDT--------------------------------    131

S1    234  KNGLFGNLIALSLGLTPNFKSNFDLAEDAKLQLSKDTYDDDLDNLLAQIGDQYADLFLAAKNLSDAILLSDILRVNTEIT   313

S2    235  KNTLFGNLIALALGLQPNFKTNFKLSEDAKLQFSKDTYEEDLEELLGKIGDDYADLFTSAKNLYDAILLSGILTVDDNST   314

S3    234  STGLFSEFLKLIVGNQADFKKHFDLEDKAPLQFSKDTYDEDLENLLGQIGDDFTDLFVSAKKLYDAILLSGILTVTDPST   313

S4    132  -----GNELS-----------------TKEQISRN-------------------------------------    144

S1    314  KAPLSASMIKRYDEHHQDLTLLKALVRQQLPEKYKEIFFDQSKNGYAGYIDGGASQEEFYKFIKPILEKM--DGTEELLV   391

S2    315  KAPLSASMIKRYVEHHEDLEKLKEFIKANKSELYHDIFKDKNKNGYAGYIENGVKQDEFYKYLKNILSKIKIDGSDYFLD   394

S3    314  KAPLSASMIERYENHQNDLAALKQFIKNNLPEKYDEVFSDQSKDGYAGYIDGKTTQETFYKYIKNLLSKF--EGTDYFLD   391

S4    145  ----SKALEEKYVAELQ----------------------------------------LERLKKDG------    165

S1    392  KLNREDLLRKQRTFDNGSIPHQIHLGELHAILRRQEDFYPFLKDNREKIEKILTFRIPYYVGPLARGNSRFAWMTRKSEE   471

S2    395  KIEREDFLRKQRTFDNGSIPHQIHLQEMHAILRRQGDYYPFLKEKQDRIEKILTFRIPYYVGPLVRKDSRFAWAEYRSDE   474

S3    392  KIEREDFLRKQRTFDNGSIPHQIHLQEMNAILRRQGEYYPFLKDNKEKIEKILTFRIPYYVGPLARGNRDFAWLTRNSDE   471

S4    166  --EVRGSINRFKTSD--------YVKEAKQLLKVQKAYHQLDQSFIDTYIDLLETRRTYYEGP--GEGSPFGW------K   227

S1    472  TITPWNFEEVVDKGASAQSFIERMTNFDKNLPNEKVLPKHSLLYEYFTVYNELTKVKYVTEGMRKPAFLSGEQKKAIVDL   551

S2    475  KITPWNFDKVIDKEKSAEKFITRMTLNDLYLPEEKVLPKHSHVYETYAVYNELTKIKYVNEQGKE-SFFDSNMKQEIFDH   553

S3    472  AIRPWNFEEIVDKASSAEDFINKMTNYDLYLPEEKVLPKHSLLYETFAVYNELTKVKFIAEGLRDYQFLDSGQKKQIVNQ   551

S4    228  DIKEW--------------YEMLMGHCTYFPEELRSVKYAYNADLYNALNDLNNLVITRDENEK---LEYYEKFQIIEN   289

S1    552  LFKTNRKVTVKQLKEDYFKKIECFDSVEISGVEDR---FNASLGTYHDLLKIIKDKDFLDNEENEDILEDIVLTLTLFED   628

S2    554  VFKENRKVTKEKLLNYLNKEFPEYRIKDLIGLDKENKSFNASLGTYHDLKKIL-DKAFLDDKVNEEVIEDIIKTLTLFED   632

S3    552  LFKENRKVTEKDIIHYLHN-VDGYDGIELKGIEKQ---FNASLSTYHDLLKIIKDKEFMDDAKNEAILENIVHTLTIFED   627

S4    290  VFKQKKKPTLKQIAKEILVNEEDIKGYRVTSTGKPEF---TNLKVYHDIKDITARKEII---ENAELLDQIAKILTIYQS   363

S1    629  REMIEERLKTYAHLFDDKVMKQLKR-RRYTGWGRLSRKLINGIRDKQSGKTILDFLKSDGFANRNFMQLIHDDSLTFKED   707

S2    633  KDMIHERLQKYSDIFTANQLKKLER-RHYTGWGRLSYKLINGIRNKENNKTILDYLIDDGSANRNFMQLINDDTLPFKQI   711
```

-continued

```
S3    628   REMIKQRLAQYDSLFDEKVIKALTR-RHYTGWGKLSAKLINGICDKQTGNTILDYLIDDGKINRNFMQLINDDGLSFKEI    706
S4    364   SEDIQEELTNLNSELTQEEIEQISNLKGYTGTHNLSLKAINLILDE------LWHTNDNQIAIFNRLKLVP---------    428

S1    708   IQKAQVSGGQDSLHEHIANLAGSPAIKKGILQTVKVVDELVKVMGRHKPENIVIEMARENQTT------QKGQKNSRERM    781

S2    712   IQKSQVVGDVDDIEAVVHDLPGSPAIKKGILQSVKIVDELVKVMG-GNPDNIVIEMARENQTT------NRGRSQSQQRL    784

S3    707   IQKAQVIGKTDDVKQVVQELSGSPAIKKGILQSIKIVDELVKVMG-HAPESIVIEMARENQTT------ARGKKNSQQRY    779

S4    429   -KKVDLSQQKEIPTTLVDDFILSPVVKRSFIQSIKVINAIIKKYG--LPNDIIIELAREKNSKDAQKMINEMQKRNRQTN    505

S1    782   KRIEEGIKELGSQIL-------KEHPVENTQLQNEKLYLYYLQNGRDMYVDQELDINRLSD----YDVDH*IVPQSFLKDD    850

S2    785   KKLQNSLKELGSNILNEEKPSYIEDKVENSHLQNDQLFYYIQNGKDMYTGDELDIDHLSD----YDIDH*IIPQAFIKDD    860

S3    780   KRIEDSLKILASGL---DSNILKENPTDNNQLQNDRLFYYLQNGKDMYTGEALDINQLSS----YDIDH*IIPQAFIKDD    852

S4    506   ERIEEIIRTTGK---------------ENAKYLIEKIKLHDMQEGKCLYSLEAIPLEDLLNNPFNYEVDH*IIPRSVSFDN    570

S1    851   SIDNKVLTRSDKNRGKSDNVPSEEVVKKMKNYWRQLLNAKLITQRKFDN-LTKAERGGL-SELD------KAGFIKRQLV    922

S2    861   SIDNRVLTSSAKNRGKSDDVPSLDIVRARKAEWVRLYKSGLISKRKFDN-LTKAERGGL-TEAD------KAGFIKRQLV    932

S3    853   SLDNRVLTSSKDNRGKSDNVPSIEVVQKRKAFWQQLLDSKLISERKFNN-LTKAERGGL-DERD------KVGFIKRQLV    924

S4    571   SFNNKVLVKQEEASKKGNRTPFQYLSSSDSKISYETFKKHILNLAKGKGRISKTKKEYLLEERDINRFSVQKDFINRNLV    650

S1    923   ETRQITKHVAQILDSRMNTKYDENDKLIREVKVITLKSKLVSDFRKDFQFYKVREINNYHHAHDAYLNAVVGTALIKKYP    1002

S2    933   ETRQITKHVAQILDARFNTEHDENDKVIRDVKVITLKSNLVSQFRKDFEFYKVREINDYHHAHDAYLNAVVGTALLKKYP    1012

S3    925   ETRQITKHVAQILDARYNTEVNEKDKKNRTVKIITLKSNLVSNFRKEFRLYKVREINDYHHAHDAYLNAVVAKAILKKYP    1004

S4    651   DTRYATRGLMNLLRSYFRVN-------NLDVKVKSINGGFTSFLRRKWKFKKERNKGYKHHAEDALIIA-----------    712

S1    1003  KLESEFVYGDYKVYDVRKMIAKSEQ--EIGKATAKYFFYSNIMNFFKTEITLANGEIRKRPLIETNGETGEIVWDKG---    1077

S2    1013  KLASEFVYGEYKKYDIRKFITNSSD-----KATAKYFFYSNLMNFFKTKVKYADGTVFERPIIETNAD-GEIAWNKQ---    1083

S3    1005  KLEPEFVYGEYQKYDLKRYISRSKDPKEVEKATEKYFFYSNLLNFFKEEVHYADGTIVKRENIEYSKDTGEIAWNKE---    1081

S4    713   --NADFIFKEWKKLDKAKKVMENQM------------------------FEEKQAESMPEIETEQEYKEIFITPHQIK    764

S1    1078  -----RDFATVRKVLSMPQVNIVKKTEVQTGGFSKESILPKRNSDKLIARKKD---WDPKKYGGFDSPTVAYSVLVVAKV    1149

S2    1084  -----IDFEKVRKVLSYPQVNIVKKVETQTGGFSKESILPKGDSDKLIPRKTKKVYWDTKKYGGFDSPTVAYSVFVVADV    1158

S3    1082  -----KDFAIIKKVLSLPQVNIVKKREVQTGGFSKESILPKGNSDKLIPRKTKDILLDTTKYGGFDSPVIAYSILLIADI    1156

S4    765   HIKDFKDYKYSHRVDKKPNRELINDTLYSTRKDDKGNTLIVNNLNGLYDKDNDKL----KKLIN-KSP----EKLLMYHH    835

S1    1150  EKGKSKKLKSVKELLGITIMERSSFEKNPI-DFLEAKG-----YKEVKKDLIIKLPKYSLFELENGRKRMLASAGELQKG    1223
```

```
S2   1159   EKGKAKKLKTVKELVGISIMERSFFEENPV-EFLENKG-----YHNIREDKLIKLPKYSLFEFEGGRRRLLASASELQKG   1232

S3   1157   EKGKAKKLKTVKTLVGITIMEKAAFEENPI-TFLENKG-----YHNVRKENILCLPKYSLFELENGRRRLLASAKELQKG   1230

S4    836   DPQTYQKLK--------LIMEQYGDEKNPLYKYYEETGNYLTKYSKKDNGPVIKKIKYYGNKLNAHLDITDDYPNSRNKV    907

S1   1224   NELALPSKYVNFLYLASHYEKLKGSPEDNEQKQLFVEQHKHYLDEIIEQISEFSKRVILADANLDKVLSAYNKH------   1297

S2   1233   NEMVLPGYLVELLYHAHRADNF-----NSTEYLNYVSEHKKEFEKVLSCVEDFANLYVDVEKNLSKIRAVADSM------   1301

S3   1231   NEIVLPVYLTTLLYHSKNVHKL-----DEPGHLEYIQKHRNEFKDLLNLVSEFSQKYVLADANLEKIKSLYADN------   1299

S4    908   VKLSLKPYRFD-VYLDNGVYKFV-----TVKNLDVIK--KENYYEVNSKAYEEAKKLKKISNQAEFIASFYNNDLIKING    979

S1   1298   RDKPIREQAENIIHLFTLTNLGAPAAFKYFDTTIDRKRYTSTKEVLDATLIHQSIT--------GLYETRI----DLSQL   1365

S2   1302   DNFSIEEISNSFINLLTLTALGAPADFNFLGEKIPRKRYTSTKECLNATLIHQSIT--------GLYETRI----DLSKL   1369

S3   1300   EQADIEILANSFINLLTFTALGAPAAFKFFGKDIDRKRYTTVSEILNATLIHQSIT--------GLYETWI----DLSKL   1367

S4    980   ELYRVIGVNNDLLNRIEVNMIDITYR-EYLENMNDKRPPRIIKTIASKT---QSIKKYSTDILGNLYEVKSKKHPQIIKK   1055

S1   1366   GGD                                                                              1368

S2   1370   GEE                                                                              1372

S3   1368   GED                                                                              1370

S4   1056   G--                                                                              1056
```

The alignment demonstrates that amino acid sequences and amino acid residues that are homologous to a reference Cas9 amino acid sequence or amino acid residue can be identified across Cas9 sequence variants, including, but not limited to Cas9 sequences from different species, by identifying the amino acid sequence or residue that aligns with the reference sequence or the reference residue using alignment programs and algorithms known in the art. This disclosure provides Cas9 variants in which one or more of the amino acid residues identified by an asterisk in SEQ ID NOs: 11-14 (e.g., S1, S2, S3, and S4, respectively) are mutated as described herein. The residues D10 and H840 in Cas9 of SEQ ID NO: 1 that correspond to the residues identified in SEQ ID NOs: 11-14 by an asterisk are referred to herein as "homologous" or "corresponding" residues. Such homologous residues can be identified by sequence alignment, e.g., as described above, and by identifying the sequence or residue that aligns with the reference sequence or residue. Similarly, mutations in Cas9 sequences that correspond to mutations identified in SEQ ID NO: 1 herein, e.g., mutations of residues 10, and 840 in SEQ ID NO: 1, are referred to herein as "homologous" or "corresponding" mutations. For example, the mutations corresponding to the D10A mutation in SEQ ID NO: 1 or S1 (SEQ ID NO: 11) for the four aligned sequences above are D11A for S2, D10A for S3, and D13A for S4; the corresponding mutations for H840A in SEQ ID NO: 1 or S1 (SEQ ID NO: 11) are H850A for S2, H842A for S3, and H560A for S4.

A total of 250 Cas9 sequences (SEQ ID NOs: 11-260) from different species are provided. Amino acid residues homologous to residues 10, and 840 of SEQ ID NO: 1 may be identified in the same manner as outlined above. All of these Cas9 sequences may be used in accordance with the present disclosure.

| Accession | Description | SEQ ID |
|---|---|---|
| WP_010922251.1 | type II CRISPR RNA-guided endonuclease Cas9 [*Streptococcus pyogenes*] | SEQ ID NO: 11 |
| WP_039695303.1 | type II CRISPR RNA-guided endonuclease Cas9 [*Streptococcus gallolyticus*] | SEQ ID NO: 12 |
| WP_045635197.1 | type II CRISPR RNA-guided endonuclease Cas9 [*Streptococcus mitis*] | SEQ ID NO: 13 |
| 5AXW_A | Cas9, Chain A, Crystal Structure [*Staphylococcus Aureus*] | SEQ ID NO: 14 |
| WP_009880683.1 | type II CRISPR RNA-guided endonuclease Cas9 [*Streptococcus pyogenes*] | SEQ ID NO: 15 |
| WP_010922251.1 | type II CRISPR RNA-guided endonuclease Cas9 [*Streptococcus pyogenes*] | SEQ ID NO: 16 |
| WP_011054416.1 | type II CRISPR RNA-guided endonuclease Cas9 [*Streptococcus pyogenes*] | SEQ ID NO: 17 |
| WP_011284745.1 | type II CRISPR RNA-guided endonuclease Cas9 [*Streptococcus pyogenes*] | SEQ ID NO: 18 |
| WP_011285506.1 | type II CRISPR RNA-guided endonuclease Cas9 [*Streptococcus pyogenes*] | SEQ ID NO: 19 |
| WP_011527619.1 | type II CRISPR RNA-guided endonuclease Cas9 [*Streptococcus pyogenes*] | SEQ ID NO: 20 |
| WP_012560673.1 | type II CRISPR RNA-guided endonuclease Cas9 [*Streptococcus pyogenes*] | SEQ ID NO: 21 |
| WP_014407541.1 | type II CRISPR RNA-guided endonuclease Cas9 [*Streptococcus pyogenes*] | SEQ ID NO: 22 |
| WP_020905136.1 | type II CRISPR RNA-guided endonuclease Cas9 [*Streptococcus pyogenes*] | SEQ ID NO: 23 |
| WP_023080005.1 | type II CRISPR RNA-guided endonuclease Cas9 [*Streptococcus pyogenes*] | SEQ ID NO: 24 |
| WP_023610282.1 | type II CRISPR RNA-guided endonuclease Cas9 [*Streptococcus pyogenes*] | SEQ ID NO: 25 |
| WP_030125963.1 | type II CRISPR RNA-guided endonuclease Cas9 [*Streptococcus pyogenes*] | SEQ ID NO: 26 |
| WP_030126706.1 | type II CRISPR RNA-guided endonuclease Cas9 [*Streptococcus pyogenes*] | SEQ ID NO: 27 |
| WP_031488318.1 | type II CRISPR RNA-guided endonuclease Cas9 [*Streptococcus pyogenes*] | SEQ ID NO: 28 |
| WP_032460140.1 | type II CRISPR RNA-guided endonuclease Cas9 [*Streptococcus pyogenes*] | SEQ ID NO: 29 |
| WP_032461047.1 | type II CRISPR RNA-guided endonuclease Cas9 [*Streptococcus pyogenes*] | SEQ ID NO: 30 |
| WP_032462016.1 | type II CRISPR RNA-guided endonuclease Cas9 [*Streptococcus pyogenes*] | SEQ ID NO: 31 |
| WP_032462936.1 | type II CRISPR RNA-guided endonuclease Cas9 [*Streptococcus pyogenes*] | SEQ ID NO: 32 |
| WP_032464890.1 | type II CRISPR RNA-guided endonuclease Cas9 [*Streptococcus pyogenes*] | SEQ ID NO: 33 |
| WP_033888930.1 | type II CRISPR RNA-guided endonuclease Cas9 [*Streptococcus pyogenes*] | SEQ ID NO: 34 |

| Accession | Description | SEQ ID |
|---|---|---|
| WP_038431314.1 | type II CRISPR RNA-guided endonuclease Cas9 [*Streptococcus pyogenes*] | SEQ ID NO: 35 |
| WP_038432938.1 | type II CRISPR RNA-guided endonuclease Cas9 [*Streptococcus pyogenes*] | SEQ ID NO: 36 |
| WP_038434062.1 | type II CRISPR RNA-guided endonuclease Cas9 [*Streptococcus pyogenes*] | SEQ ID NO: 37 |
| BAQ51233.1 | CRISPR-associated protein, Csn1 family [*Streptococcus pyogenes*] | SEQ ID NO: 38 |
| KGE60162.1 | hypothetical protein MGAS2111_0903 [*Streptococcus pyogenes* MGAS2111] | SEQ ID NO: 39 |
| KGE60856.1 | CRISPR-associated endonuclease protein [*Streptococcus pyogenes* SS1447] | SEQ ID NO: 40 |
| WP_002989955.1 | MULTISPECIES: type II CRISPR RNA-guided endonuclease Cas9 [*Streptococcus*] | SEQ ID NO: 41 |
| WP_003030002.1 | MULTISPECIES: type II CRISPR RNA-guided endonuclease Cas9 [*Streptococcus*] | SEQ ID NO: 42 |
| WP_003065552.1 | MULTISPECIES: type II CRISPR RNA-guided endonuclease Cas9 [*Streptococcus*] | SEQ ID NO: 43 |
| WP_001040076.1 | type II CRISPR RNA-guided endonuclease Cas9 [*Streptococcus agalactiae*] | SEQ ID NO: 44 |
| WP_001040078.1 | type II CRISPR RNA-guided endonuclease Cas9 [*Streptococcus agalactiae*] | SEQ ID NO: 45 |
| WP_001040080.1 | type II CRISPR RNA-guided endonuclease Cas9 [*Streptococcus agalactiae*] | SEQ ID NO: 46 |
| WP_001040081.1 | type II CRISPR RNA-guided endonuclease Cas9 [*Streptococcus agalactiae*] | SEQ ID NO: 47 |
| WP_001040083.1 | type II CRISPR RNA-guided endonuclease Cas9 [*Streptococcus agalactiae*] | SEQ ID NO: 48 |
| WP_001040085.1 | type II CRISPR RNA-guided endonuclease Cas9 [*Streptococcus agalactiae*] | SEQ ID NO: 49 |
| WP_001040087.1 | type II CRISPR RNA-guided endonuclease Cas9 [*Streptococcus agalactiae*] | SEQ ID NO: 50 |
| WP_001040088.1 | type II CRISPR RNA-guided endonuclease Cas9 [*Streptococcus agalactiae*] | SEQ ID NO: 51 |
| WP_001040089.1 | type II CRISPR RNA-guided endonuclease Cas9 [*Streptococcus agalactiae*] | SEQ ID NO: 52 |
| WP_001040090.1 | type II CRISPR RNA-guided endonuclease Cas9 [*Streptococcus agalactiae*] | SEQ ID NO: 53 |
| WP_001040091.1 | type II CRISPR RNA-guided endonuclease Cas9 [*Streptococcus agalactiae*] | SEQ ID NO: 54 |
| WP_001040092.1 | type II CRISPR RNA-guided endonuclease Cas9 [*Streptococcus agalactiae*] | SEQ ID NO: 55 |
| WP_001040094.1 | type II CRISPR RNA-guided endonuclease Cas9 [*Streptococcus agalactiae*] | SEQ ID NO: 56 |
| WP_001040095.1 | type II CRISPR RNA-guided endonuclease Cas9 [*Streptococcus agalactiae*] | SEQ ID NO: 57 |
| WP_001040096.1 | type II CRISPR RNA-guided endonuclease Cas9 [*Streptococcus agalactiae*] | SEQ ID NO: 58 |
| WP_001040097.1 | type II CRISPR RNA-guided endonuclease Cas9 [*Streptococcus agalactiae*] | SEQ ID NO: 59 |
| WP_001040098.1 | type II CRISPR RNA-guided endonuclease Cas9 [*Streptococcus agalactiae*] | SEQ ID NO: 60 |
| WP_001040099.1 | type II CRISPR RNA-guided endonuclease Cas9 [*Streptococcus agalactiae*] | SEQ ID NO: 61 |
| WP_001040100.1 | type II CRISPR RNA-guided endonuclease Cas9 [*Streptococcus agalactiae*] | SEQ ID NO: 62 |
| WP_001040104.1 | type II CRISPR RNA-guided endonuclease Cas9 [*Streptococcus agalactiae*] | SEQ ID NO: 63 |
| WP_001040105.1 | type II CRISPR RNA-guided endonuclease Cas9 [*Streptococcus agalactiae*] | SEQ ID NO: 64 |
| WP_001040106.1 | type II CRISPR RNA-guided endonuclease Cas9 [*Streptococcus agalactiae*] | SEQ ID NO: 65 |
| WP_001040107.1 | type II CRISPR RNA-guided endonuclease Cas9 [*Streptococcus agalactiae*] | SEQ ID NO: 66 |
| WP_001040108.1 | type II CRISPR RNA-guided endonuclease Cas9 [*Streptococcus agalactiae*] | SEQ ID NO: 67 |
| WP_001040109.1 | type II CRISPR RNA-guided endonuclease Cas9 [*Streptococcus agalactiae*] | SEQ ID NO: 68 |
| WP_001040110.1 | type II CRISPR RNA-guided endonuclease Cas9 [*Streptococcus agalactiae*] | SEQ ID NO: 69 |
| WP_015058523.1 | type II CRISPR RNA-guided endonuclease Cas9 [*Streptococcus agalactiae*] | SEQ ID NO: 70 |
| WP_017643650.1 | type II CRISPR RNA-guided endonuclease Cas9 [*Streptococcus agalactiae*] | SEQ ID NO: 71 |
| WP_017647151.1 | type II CRISPR RNA-guided endonuclease Cas9 [*Streptococcus agalactiae*] | SEQ ID NO: 72 |
| WP_017648376.1 | type II CRISPR RNA-guided endonuclease Cas9 [*Streptococcus agalactiae*] | SEQ ID NO: 73 |
| WP_017649527.1 | type II CRISPR RNA-guided endonuclease Cas9 [*Streptococcus agalactiae*] | SEQ ID NO: 74 |
| WP_017771611.1 | type II CRISPR RNA-guided endonuclease Cas9 [*Streptococcus agalactiae*] | SEQ ID NO: 75 |
| WP_017771984.1 | type II CRISPR RNA-guided endonuclease Cas9 [*Streptococcus agalactiae*] | SEQ ID NO: 76 |
| CFQ25032.1 | CRISPR-associated protein [*Streptococcus agalactiae*] | SEQ ID NO: 77 |
| CFV16040.1 | CRISPR-associated protein [*Streptococcus agalactiae*] | SEQ ID NO: 78 |
| KLJ37842.1 | CRISPR-associated protein Csn1 [*Streptococcus agalactiae*] | SEQ ID NO: 79 |
| KLJ72361.1 | CRISPR-associated protein Csn1 [*Streptococcus agalactiae*] | SEQ ID NO: 80 |
| KLL20707.1 | CRISPR-associated protein Csn1 [*Streptococcus agalactiae*] | SEQ ID NO: 81 |
| KLL42645.1 | CRISPR-associated protein Csn1 [*Streptococcus agalactiae*] | SEQ ID NO: 82 |
| WP_047207273.1 | type II CRISPR RNA-guided endonuclease Cas9 [*Streptococcus agalactiae*] | SEQ ID NO: 83 |
| WP_047209694.1 | type II CRISPR RNA-guided endonuclease Cas9 [*Streptococcus agalactiae*] | SEQ ID NO: 84 |
| WP_050198062.1 | type II CRISPR RNA-guided endonuclease Cas9 [*Streptococcus agalactiae*] | SEQ ID NO: 85 |
| WP_050201642.1 | type II CRISPR RNA-guided endonuclease Cas9 [*Streptococcus agalactiae*] | SEQ ID NO: 86 |
| WP_050204027.1 | type II CRISPR RNA-guided endonuclease Cas9 [*Streptococcus agalactiae*] | SEQ ID NO: 87 |
| WP_050881965.1 | type II CRISPR RNA-guided endonuclease Cas9 [*Streptococcus agalactiae*] | SEQ ID NO: 88 |
| WP_050886065.1 | type II CRISPR RNA-guided endonuclease Cas9 [*Streptococcus agalactiae*] | SEQ ID NO: 89 |
| AHN30376.1 | CRISPR-associated protein Csn1 [*Streptococcus agalactiae* 138P] | SEQ ID NO: 90 |
| EAO78426.1 | reticulocyte binding protein [*Streptococcus agalactiae* H36B] | SEQ ID NO: 91 |
| CCW42055.1 | CRISPR-associated protein, SAG0894 family [*Streptococcus agalactiae* ILRI112] | SEQ ID NO:92 |
| WP_003041502.1 | type II CRISPR RNA-guided endonuclease Cas9 [*Streptococcus anginosus*] | SEQ ID NO: 93 |
| WP_037593752.1 | type II CRISPR RNA-guided endonuclease Cas9 [*Streptococcus anginosus*] | SEQ ID NO: 94 |
| WP_049516684.1 | CRISPR-associated protein Csn1 [*Streptococcus anginosus*] | SEQ ID NO: 95 |
| GAD46167.1 | hypothetical protein ANG6_0662 [*Streptococcus anginosus* T5] | SEQ ID NO: 96 |
| WP_018363470.1 | type II CRISPR RNA-guided endonuclease Cas9 [*Streptococcus caballi*] | SEQ ID NO: 97 |
| WP_003043819.1 | type II CRISPR RNA-guided endonuclease Cas9 [*Streptococcus canis*] | SEQ ID NO: 98 |
| WP_006269658.1 | type II CRISPR RNA-guided endonuclease Cas9 [*Streptococcus constellatus*] | SEQ ID NO: 99 |
| WP_048800889.1 | type II CRISPR RNA-guided endonuclease Cas9 [*Streptococcus constellatus*] | SEQ ID NO: 100 |
| WP_012767106.1 | type II CRISPR RNA-guided endonuclease Cas9 [*Streptococcus dysgalactiae*] | SEQ ID NO: 101 |
| WP_014612333.1 | type II CRISPR RNA-guided endonuclease Cas9 [*Streptococcus dysgalactiae*] | SEQ ID NO: 102 |
| WP_015017095.1 | type II CRISPR RNA-guided endonuclease Cas9 [*Streptococcus dysgalactiae*] | SEQ ID NO: 103 |
| WP_015057649.1 | type II CRISPR RNA-guided endonuclease Cas9 [*Streptococcus dysgalactiae*] | SEQ ID NO: 104 |
| WP_048327215.1 | type II CRISPR RNA-guided endonuclease Cas9 [*Streptococcus dysgalactiae*] | SEQ ID NO: 105 |
| WP_049519324.1 | CRISPR-associated protein Csn1 [*Streptococcus dysgalactiae*] | SEQ ID NO: 106 |
| WP_012515931.1 | type II CRISPR RNA-guided endonuclease Cas9 [*Streptococcus equi*] | SEQ ID NO: 107 |
| WP_021320964.1 | type II CRISPR RNA-guided endonuclease Cas9 [*Streptococcus equi*] | SEQ ID NO: 108 |
| WP_037581760.1 | type II CRISPR RNA-guided endonuclease Cas9 [*Streptococcus equi*] | SEQ ID NO: 109 |
| WP_004232481.1 | type II CRISPR RNA-guided endonuclease Cas9 [*Streptococcus equinus*] | SEQ ID NO: 110 |
| WP_009854540.1 | type II CRISPR RNA-guided endonuclease Cas9 [*Streptococcus gallolyticus*] | SEQ ID NO: 111 |
| WP_012962174.1 | type II CRISPR RNA-guided endonuclease Cas9 [*Streptococcus gallolyticus*] | SEQ ID NO: 112 |
| WP_039695303.1 | type II CRISPR RNA-guided endonuclease Cas9 [*Streptococcus gallolyticus*] | SEQ ID NO: 113 |

| | | |
|---|---|---|
| WP_014334983.1 | type II CRISPR RNA-guided endonuclease Cas9 [*Streptococcus infantarius*] | SEQ ID NO: 114 |
| WP_003099269.1 | type II CRISPR RNA-guided endonuclease Cas9 [*Streptococcus iniae*] | SEQ ID NO: 115 |
| AHY15608.1 | CRISPR-associated protein Csn1 [*Streptococcus iniae*] | SEQ ID NO: 116 |
| AHY17476.1 | CRISPR-associated protein Csn1 [*Streptococcus iniae*] | SEQ ID NO: 117 |
| ESR09100.1 | hypothetical protein IUSA1_08595 [*Streptococcus iniae* IUSA1] | SEQ ID NO: 118 |
| AGM98575.1 | CRISPR-associated protein Cas9/Csn1, subtype II/NMEMI [*Streptococcus iniae* SF1] | SEQ ID NO: 119 |
| ALF27331.1 | CRISPR-associated protein Csn1 [*Streptococcus intermedius*] | SEQ ID NO: 120 |
| WP_018372492.1 | type II CRISPR RNA-guided endonuclease Cas9 [*Streptococcus massiliensis*] | SEQ ID NO: 121 |
| WP_045618028.1 | type II CRISPR RNA-guided endonuclease Cas9 [*Streptococcus mitis*] | SEQ ID NO: 122 |
| WP_045635197.1 | type II CRISPR RNA-guided endonuclease Cas9 [*Streptococcus mitis*] | SEQ ID NO: 123 |
| WP_002263549.1 | type II CRISPR RNA-guided endonuclease Cas9 [*Streptococcus mutans*] | SEQ ID NO: 124 |
| WP_002263887.1 | type II CRISPR RNA-guided endonuclease Cas9 [*Streptococcus mutans*] | SEQ ID NO: 125 |
| WP_002264920.1 | type II CRISPR RNA-guided endonuclease Cas9 [*Streptococcus mutans*] | SEQ ID NO: 126 |
| WP_002269043.1 | type II CRISPR RNA-guided endonuclease Cas9 [*Streptococcus mutans*] | SEQ ID NO: 127 |
| WP_002269448.1 | type II CRISPR RNA-guided endonuclease Cas9 [*Streptococcus mutans*] | SEQ ID NO: 128 |
| WP_002271977.1 | type II CRISPR RNA-guided endonuclease Cas9 [*Streptococcus mutans*] | SEQ ID NO: 129 |
| WP_002272766.1 | type II CRISPR RNA-guided endonuclease Cas9 [*Streptococcus mutans*] | SEQ ID NO: 130 |
| WP_002273241.1 | type II CRISPR RNA-guided endonuclease Cas9 [*Streptococcus mutans*] | SEQ ID NO: 131 |
| WP_002275430.1 | type II CRISPR RNA-guided endonuclease Cas9 [*Streptococcus mutans*] | SEQ ID NO: 132 |
| WP_002276448.1 | type II CRISPR RNA-guided endonuclease Cas9 [*Streptococcus mutans*] | SEQ ID NO: 133 |
| WP_002277050.1 | type II CRISPR RNA-guided endonuclease Cas9 [*Streptococcus mutans*] | SEQ ID NO: 134 |
| WP_002277364.1 | type II CRISPR RNA-guided endonuclease Cas9 [*Streptococcus mutans*] | SEQ ID NO: 135 |
| WP_002279025.1 | type II CRISPR RNA-guided endonuclease Cas9 [*Streptococcus mutans*] | SEQ ID NO: 136 |
| WP_002279859.1 | type II CRISPR RNA-guided endonuclease Cas9 [*Streptococcus mutans*] | SEQ ID NO: 137 |
| WP_002280230.1 | type II CRISPR RNA-guided endonuclease Cas9 [*Streptococcus mutans*] | SEQ ID NO: 138 |
| WP_002281696.1 | type II CRISPR RNA-guided endonuclease Cas9 [*Streptococcus mutans*] | SEQ ID NO: 139 |
| WP_002282247.1 | type II CRISPR RNA-guided endonuclease Cas9 [*Streptococcus mutans*] | SEQ ID NO: 140 |
| WP_002282906.1 | type II CRISPR RNA-guided endonuclease Cas9 [*Streptococcus mutans*] | SEQ ID NO: 141 |
| WP_002283846.1 | type II CRISPR RNA-guided endonuclease Cas9 [*Streptococcus mutans*] | SEQ ID NO: 142 |
| WP_002287255.1 | type II CRISPR RNA-guided endonuclease Cas9 [*Streptococcus mutans*] | SEQ ID NO: 143 |
| WP_002288990.1 | type II CRISPR RNA-guided endonuclease Cas9 [*Streptococcus mutans*] | SEQ ID NO: 144 |
| WP_002289641.1 | type II CRISPR RNA-guided endonuclease Cas9 [*Streptococcus mutans*] | SEQ ID NO: 145 |
| WP_002290427.1 | type II CRISPR RNA-guided endonuclease Cas9 [*Streptococcus mutans*] | SEQ ID NO: 146 |
| WP_002295753.1 | type II CRISPR RNA-guided endonuclease Cas9 [*Streptococcus mutans*] | SEQ ID NO: 147 |
| WP_002296423.1 | type II CRISPR RNA-guided endonuclease Cas9 [*Streptococcus mutans*] | SEQ ID NO: 148 |
| WP_002304487.1 | type II CRISPR RNA-guided endonuclease Cas9 [*Streptococcus mutans*] | SEQ ID NO: 149 |
| WP_002305844.1 | type II CRISPR RNA-guided endonuclease Cas9 [*Streptococcus mutans*] | SEQ ID NO: 150 |
| WP_002307203.1 | type II CRISPR RNA-guided endonuclease Cas9 [*Streptococcus mutans*] | SEQ ID NO: 151 |
| WP_002310390.1 | type II CRISPR RNA-guided endonuclease Cas9 [*Streptococcus mutans*] | SEQ ID NO: 152 |
| WP_002352408.1 | type II CRISPR RNA-guided endonuclease Cas9 [*Streptococcus mutans*] | SEQ ID NO: 153 |
| WP_012997688.1 | type II CRISPR RNA-guided endonuclease Cas9 [*Streptococcus mutans*] | SEQ ID NO: 154 |
| WP_014677909.1 | type II CRISPR RNA-guided endonuclease Cas9 [*Streptococcus mutans*] | SEQ ID NO: 155 |
| WP_019312892.1 | type II CRISPR RNA-guided endonuclease Cas9 [*Streptococcus mutans*] | SEQ ID NO: 156 |
| WP_019313659.1 | type II CRISPR RNA-guided endonuclease Cas9 [*Streptococcus mutans*] | SEQ ID NO: 157 |
| WP_019314093.1 | type II CRISPR RNA-guided endonuclease Cas9 [*Streptococcus mutans*] | SEQ ID NO: 158 |
| WP_019315370.1 | type II CRISPR RNA-guided endonuclease Cas9 [*Streptococcus mutans*] | SEQ ID NO: 159 |
| WP_019803776.1 | type II CRISPR RNA-guided endonuclease Cas9 [*Streptococcus mutans*] | SEQ ID NO: 160 |
| WP_019805234.1 | type II CRISPR RNA-guided endonuclease Cas9 [*Streptococcus mutans*] | SEQ ID NO: 161 |
| WP_024783594.1 | type II CRISPR RNA-guided endonuclease Cas9 [*Streptococcus mutans*] | SEQ ID NO: 162 |
| WP_024784288.1 | type II CRISPR RNA-guided endonuclease Cas9 [*Streptococcus mutans*] | SEQ ID NO: 163 |
| WP_024784666.1 | type II CRISPR RNA-guided endonuclease Cas9 [*Streptococcus mutans*] | SEQ ID NO: 164 |
| WP_024784894.1 | type II CRISPR RNA-guided endonuclease Cas9 [*Streptococcus mutans*] | SEQ ID NO: 165 |
| WP_024786433.1 | type II CRISPR RNA-guided endonuclease Cas9 [*Streptococcus mutans*] | SEQ ID NO: 166 |
| WP_049473442.1 | CRISPR-associated protein Csn1 [*Streptococcus mutans*] | SEQ ID NO: 167 |
| WP_049474547.1 | CRISPR-associated protein Csn1 [*Streptococcus mutans*] | SEQ ID NO: 168 |
| EMC03581.1 | hypothetical protein SMU69_09359 [*Streptococcus mutans* NLML4] | SEQ ID NO: 169 |
| WP_000428612.1 | type II CRISPR RNA-guided endonuclease Cas9 [*Streptococcus oralis*] | SEQ ID NO: 170 |
| WP_000428613.1 | type II CRISPR RNA-guided endonuclease Cas9 [*Streptococcus oralis*] | SEQ ID NO: 171 |
| WP_049523028.1 | CRISPR-associated protein Csn1 [*Streptococcus parasanguinis*] | SEQ ID NO: 172 |
| WP_003107102.1 | type II CRISPR RNA-guided endonuclease Cas9 [*Streptococcus parauberis*] | SEQ ID NO: 173 |
| WP_054279288.1 | type II CRISPR RNA-guided endonuclease Cas9 [*Streptococcus phocae*] | SEQ ID NO: 174 |
| WP_049531101.1 | CRISPR-associated protein Csn1 [*Streptococcus pseudopneumoniae*] | SEQ ID NO: 175 |
| WP_049538452.1 | CRISPR-associated protein Csn1 [*Streptococcus pseudopneumoniae*] | SEQ ID NO: 176 |
| WP_049549711.1 | CRISPR-associated protein Csn1 [*Streptococcus pseudopneumoniae*] | SEQ ID NO: 177 |
| WP_007896501.1 | type II CRISPR RNA-guided endonuclease Cas9 [*Streptococcus pseudoporcinus*] | SEQ ID NO: 178 |
| EFR44625.1 | CRISPR-associated protein, Csn1 family [*Streptococcus pseudoporcinus* SPIN 20026] | SEQ ID NO: 179 |
| WP_002897477.1 | type II CRISPR RNA-guided endonuclease Cas9 [*Streptococcus sanguinis*] | SEQ ID NO: 180 |
| WP_002906454.1 | type II CRISPR RNA-guided endonuclease Cas9 [*Streptococcus sanguinis*] | SEQ ID NO: 181 |
| WP_009729476.1 | type II CRISPR RNA-guided endonuclease Cas9 [*Streptococcus* sp. F0441] | SEQ ID NO: 182 |
| CQR24647.1 | CRISPR-associated protein [*Streptococcus* sp. FF10] | SEQ ID NO: 183 |
| WP_000066813.1 | type II CRISPR RNA-guided endonuclease Cas9 [*Streptococcus* sp. M334] | SEQ ID NO: 184 |
| WP_009754323.1 | type II CRISPR RNA-guided endonuclease Cas9 [*Streptococcus* sp. taxon 056] | SEQ ID NO: 185 |
| WP_044674937.1 | type II CRISPR RNA-guided endonuclease Cas9 [*Streptococcus suis*] | SEQ ID NO: 186 |
| WP_044676715.1 | type II CRISPR RNA-guided endonuclease Cas9 [*Streptococcus suis*] | SEQ ID NO: 187 |
| WP_044680361.1 | type II CRISPR RNA-guided endonuclease Cas9 [*Streptococcus suis*] | SEQ ID NO: 188 |
| WP_044681799.1 | type II CRISPR RNA-guided endonuclease Cas9 [*Streptococcus suis*] | SEQ ID NO: 189 |
| WP_049533112.1 | CRISPR-associated protein Csn1 [*Streptococcus suis*] | SEQ ID NO: 190 |
| WP_029090905.1 | type II CRISPR RNA-guided endonuclease Cas9 [*Brochothrix thermosphacta*] | SEQ ID NO: 191 |
| WP_006506696.1 | type II CRISPR RNA-guided endonuclease Cas9 [*Catenibacterium mitsuokai*] | SEQ ID NO: 192 |

| Accession | Description | SEQ ID |
|---|---|---|
| AIT42264.1 | Cas9hc:NLS:HA [Cloning vector pYB196] | SEQ ID NO: 193 |
| WP_034440723.1 | type II CRISPR endonuclease Cas9 [*Clostridiales bacterium* S5-A11] | SEQ ID NO: 194 |
| AKQ21048.1 | Cas9 [CRISPR-mediated gene targeting vector p(bhsp68-Cas9)] | SEQ ID NO: 195 |
| WP_004636532.1 | type II CRISPR RNA-guided endonuclease Cas9 [*Dolosigranulum pigrum*] | SEQ ID NO: 196 |
| WP_002364836.1 | MULTISPECIES: type II CRISPR RNA-guided endonuclease Cas9 [*Enterococcus*] | SEQ ID NO: 197 |
| WP_016631044.1 | MULTISPECIES: type II CRISPR RNA-guided endonuclease Cas9 [*Enterococcus*] | SEQ ID NO: 198 |
| EMS75795.1 | hypothetical protein H318_06676 [*Enterococcus durans* IPLA 655] | SEQ ID NO: 199 |
| WP_002373311.1 | type II CRISPR RNA-guided endonuclease Cas9 [*Enterococcus faecalis*] | SEQ ID NO: 200 |
| WP_002378009.1 | type II CRISPR RNA-guided endonuclease Cas9 [*Enterococcus faecalis*] | SEQ ID NO: 201 |
| WP_002407324.1 | type II CRISPR RNA-guided endonuclease Cas9 [*Enterococcus faecalis*] | SEQ ID NO: 202 |
| WP_002413717.1 | type II CRISPR RNA-guided endonuclease Cas9 [*Enterococcus faecalis*] | SEQ ID NO: 203 |
| WP_010775580.1 | type II CRISPR RNA-guided endonuclease Cas9 [*Enterococcus faecalis*] | SEQ ID NO: 204 |
| WP_010818269.1 | type II CRISPR RNA-guided endonuclease Cas9 [*Enterococcus faecalis*] | SEQ ID NO: 205 |
| WP_010824395.1 | type II CRISPR RNA-guided endonuclease Cas9 [*Enterococcus faecalis*] | SEQ ID NO: 206 |
| WP_016622645.1 | type II CRISPR RNA-guided endonuclease Cas9 [*Enterococcus faecalis*] | SEQ ID NO: 207 |
| WP_033624816.1 | type II CRISPR RNA-guided endonuclease Cas9 [*Enterococcus faecalis*] | SEQ ID NO: 208 |
| WP_033625576.1 | type II CRISPR RNA-guided endonuclease Cas9 [*Enterococcus faecalis*] | SEQ ID NO: 209 |
| WP_033789179.1 | type II CRISPR RNA-guided endonuclease Cas9 [*Enterococcus faecalis*] | SEQ ID NO: 210 |
| WP_002310644.1 | type II CRISPR RNA-guided endonuclease Cas9 [*Enterococcus faecium*] | SEQ ID NO: 211 |
| WP_002312694.1 | type II CRISPR RNA-guided endonuclease Cas9 [*Enterococcus faecium*] | SEQ ID NO: 212 |
| WP_002314015.1 | type II CRISPR RNA-guided endonuclease Cas9 [*Enterococcus faecium*] | SEQ ID NO: 213 |
| WP_002320716.1 | type II CRISPR RNA-guided endonuclease Cas9 [*Enterococcus faecium*] | SEQ ID NO: 214 |
| WP_002330729.1 | type II CRISPR RNA-guided endonuclease Cas9 [*Enterococcus faecium*] | SEQ ID NO: 215 |
| WP_002335161.1 | type II CRISPR RNA-guided endonuclease Cas9 [*Enterococcus faecium*] | SEQ ID NO: 216 |
| WP_002345439.1 | type II CRISPR RNA-guided endonuclease Cas9 [*Enterococcus faecium*] | SEQ ID NO: 217 |
| WP_034867970.1 | type II CRISPR RNA-guided endonuclease Cas9 [*Enterococcus faecium*] | SEQ ID NO: 218 |
| WP_047937432.1 | type II CRISPR RNA-guided endonuclease Cas9 [*Enterococcus faecium*] | SEQ ID NO: 219 |
| WP_010720994.1 | type II CRISPR RNA-guided endonuclease Cas9 [*Enterococcus hirae*] | SEQ ID NO: 220 |
| WP_010737004.1 | type II CRISPR RNA-guided endonuclease Cas9 [*Enterococcus hirae*] | SEQ ID NO: 221 |
| WP_034700478.1 | type II CRISPR RNA-guided endonuclease Cas9 [*Enterococcus hirae*] | SEQ ID NO: 222 |
| WP_007209003.1 | type II CRISPR RNA-guided endonuclease Cas9 [*Enterococcus italicus*] | SEQ ID NO: 223 |
| WP_023519017.1 | type II CRISPR RNA-guided endonuclease Cas9 [*Enterococcus mundtii*] | SEQ ID NO: 224 |
| WP_010770040.1 | type II CRISPR RNA-guided endonuclease Cas9 [*Enterococcus phoeniculicola*] | SEQ ID NO: 225 |
| WP_048604708.1 | type II CRISPR RNA-guided endonuclease Cas9 [*Enterococcus* sp. AM1] | SEQ ID NO: 226 |
| WP_010750235.1 | type II CRISPR RNA-guided endonuclease Cas9 [*Enterococcus villorum*] | SEQ ID NO: 227 |
| AII16583.1 | Cas9 endonuclease [Expression vector pCas9] | SEQ ID NO: 228 |
| WP_029073316.1 | type II CRISPR RNA-guided endonuclease Cas9 [*Kandleria vitulina*] | SEQ ID NO: 229 |
| WP_031589969.1 | type II CRISPR RNA-guided endonuclease Cas9 [*Kandleria vitulina*] | SEQ ID NO: 230 |
| KDA45870.1 | CRISPR-associated protein Cas9/Csn1, subtype II/NMEMI [*Lactobacillus animalis*] | SEQ ID NO: 231 |
| WP_039099354.1 | type II CRISPR RNA-guided endonuclease Cas9 [*Lactobacillus curvatus*] | SEQ ID NO: 232 |
| AKP02966.1 | hypothetical protein ABB45_04605 [*Lactobacillus farciminis*] | SEQ ID NO: 233 |
| WP_010991369.1 | type II CRISPR RNA-guided endonuclease Cas9 [*Listeria innocua*] | SEQ ID NO: 234 |
| WP_033838504.1 | type II CRISPR RNA-guided endonuclease Cas9 [*Listeria innocua*] | SEQ ID NO: 235 |
| EHN60060.1 | CRISPR-associated protein, Csn1 family [*Listeria innocua* ATCC 33091] | SEQ ID NO: 236 |
| EFR89594.1 | crispr-associated protein, Csn1 family [*Listeria innocua* FSL S4-378] | SEQ ID NO: 237 |
| WP_038409211.1 | type II CRISPR RNA-guided endonuclease Cas9 [*Listeria ivanovii*] | SEQ ID NO: 238 |
| EFR95520.1 | crispr-associated protein Csn1 [*Listeria ivanovii* FSL F6-596] | SEQ ID NO: 239 |
| WP_003723650.1 | type II CRISPR RNA-guided endonuclease Cas9 [*Listeria monocytogenes*] | SEQ ID NO: 240 |
| WP_003727705.1 | type II CRISPR RNA-guided endonuclease Cas9 [*Listeria monocytogenes*] | SEQ ID NO: 241 |
| WP_003730785.1 | type II CRISPR RNA-guided endonuclease Cas9 [*Listeria monocytogenes*] | SEQ ID NO: 242 |
| WP_003733029.1 | type II CRISPR RNA-guided endonuclease Cas9 [*Listeria monocytogenes*] | SEQ ID NO: 243 |
| WP_003739838.1 | type II CRISPR RNA-guided endonuclease Cas9 [*Listeria monocytogenes*] | SEQ ID NO: 244 |
| WP_014601172.1 | type II CRISPR RNA-guided endonuclease Cas9 [*Listeria monocytogenes*] | SEQ ID NO: 245 |
| WP_023548323.1 | type II CRISPR RNA-guided endonuclease Cas9 [*Listeria monocytogenes*] | SEQ ID NO: 246 |
| WP_031665337.1 | type II CRISPR RNA-guided endonuclease Cas9 [*Listeria monocytogenes*] | SEQ ID NO: 247 |
| WP_031669209.1 | type II CRISPR RNA-guided endonuclease Cas9 [*Listeria monocytogenes*] | SEQ ID NO: 248 |
| WP_033920898.1 | type II CRISPR RNA-guided endonuclease Cas9 [*Listeria monocytogenes*] | SEQ ID NO: 249 |
| AKI42028.1 | CRISPR-associated protein [*Listeria monocytogenes*] | SEQ ID NO: 250 |
| AKI50529.1 | CRISPR-associated protein [*Listeria monocytogenes*] | SEQ ID NO: 251 |
| EFR83390.1 | crispr-associated protein Csn1 [*Listeria monocytogenes* FSL F2-208] | SEQ ID NO: 252 |
| WP_046323366.1 | type II CRISPR RNA-guided endonuclease Cas9 [*Listeria seeligeri*] | SEQ ID NO: 253 |
| AKE81011.1 | Cas9 [Plant multiplex genome editing vector pYLCRISPR/Cas9Pubi-H] | SEQ ID NO: 254 |
| CUO82355.1 | Uncharacterized protein conserved in bacteria [*Roseburia hominis*] | SEQ ID NO: 255 |
| WP_033162887.1 | type II CRISPR RNA-guided endonuclease Cas9 [*Sharpea azabuensis*] | SEQ ID NO: 256 |
| AGZ01981.1 | Cas9 endonuclease [synthetic construct] | SEQ ID NO: 257 |
| AKA60242.1 | nuclease deficient Cas9 [synthetic construct] | SEQ ID NO: 258 |
| AKS40380.1 | Cas9 [Synthetic plasmid pFC330] | SEQ ID NO: 259 |
| 4UN5_B | Cas9, Chain B, Crystal Structure | SEQ ID NO: 260 |

Non-Limiting Examples of Suitable Deaminase Domains are Provided.

Human AID (SEQ ID NO: 270)

MDSLLMNRRKFLYQFKNVRWAKGRRETYLCYVVKRRDSATSFSLDFGYLRNKNGCHVELLFLRYISDWD

LDPGRCYRVTWFTSWSPCYDCARHVADFLRGNPNLSLRIFTARLYFCEDRKAEPEGLRRLHRAGVQIAIMT

FKDYFYCWNTFVENHERTFKAWEGLHENSVRLSRQLRRILLPLYEVDDLRDAFRTLGL
(underline: nuclear localization signal; double underline: nuclear export signal)

Mouse AID (SEQ ID NO: 271)

MDSLLMKQKKFLYHFKNVRWAKGRHETYLCYVVKRRDSATSCSLDFGHLRNKSGCHVELLFLRYISDWD

LDPGRCYRVTWFTSWSPCYDCARHVAEFLRWNPNLSLRIFTARLYFCEDRKAEPEGLRRLHRAGVQIGIMT

FKDYFYCWNTFVENRERTFKAWEGLHENSVRLTRQLRRILLPLYEVDDLRDAFRMLGF
(underline: nuclear localization signal; double underline: nuclear export signal)

Dog AID (SEQ ID NO: 272)

MDSLLMKQRKFLYHFKNVRWAKGRHETYLCYVVKRRDSATSFSLDFGHLRNKSGCHVELLFLRYISDWD

LDPGRCYRVTWFTSWSPCYDCARHVADFLRGYPNLSLRIFAARLYFCEDRKAEPEGLRRLHRAGVQIAIMT

FKDYFYCWNTFVENREKTFKAWEGLHENSVRLSRQLRRILLPLYEVDDLRDAFRTLGL
(underline: nuclear localization signal; double underline: nuclear export signal)

Bovine AID (SEQ ID NO: 273)

MDSLLKKQRQFLYQFKNVRWAKGRHETYLCYVVKRRDSPTSFSLDFGHLRNKAGCHVELLFLRYISDWD

LDPGRCYRVTWFTSWSPCYDCARHVADFLRGYPNLSLRIFTARLYFCDKERKAEPEGLRRLHRAGVQIAIM

TFKDYFYCWNTFVENHERTFKAWEGLHENSVRLSRQLRRILLPLYEVDDLRDAFRTLGL (underline: nuclear localization signal; double underline: nuclear export signal)

Mouse APOBEC-3 (SEQ ID NO: 274)

MGPFCLGCSHRKCYSPIRNLISQETFKFHFKNLGYAKGRKDTFLCYEVTRKDCDSPVSLHHGVFKNKDNI*H*

*AEICFLYWFHDKVLKVLSPREEFKITWYMSWSPCFEC*AEQIVRFLATHHNLSLDIFSSRLYNVQDPETQQNLCR

LVQEGAQVAAMDLYEFKKCWKKFVDNGGRRFRPWKRLLTNFRYQDSKLQEILRPCYIPVPSSSSSTLSNIC

LTKGLPETRFCVEGRRMDPLSEEEFYSQFYNQRVKHLCYYHRMKPYLCYQLEQFNGQAPLKGCLLSEKGK

*QHAEILFLDKIRSMELSQVTITCYLTWSPCPNC*AWQLAAFKRDRPDLILHIYTSRLYFHWKRPFQKGLCSLWQ

SGILVDVMDLPQFTDCWTNFVNPKRPFWPWKGLEIISRRTQRRLRRIKESWGLQDLVNDFGNLQLGPPMS
(italic: nucleic acid editing domain)

Rat APOBEC-3 (SEQ ID NO: 275)

MGPFCLGCSHRKCYSPIRNLISQETFKFHFKNLRYAIDRKDTFLCYEVTRKDCDSPVSLHHGVFKNKDNI*HA*

*EICFLYWFHDKVLKVLSPREEFKITWYMSWSPCFEC*AEQVLRFLATHHNLSLDIFSSRLYNIRDPENQQNLCRL

VQEGAQVAAMDLYEFKKCWKKFVDNGGRRFRPWKKLLTNFRYQDSKLQEILRPCYIPVPSSSSSTLSNICL

TKGLPETRFCVERRRVHLLSEEEFYSQFYNQRVKHLCYYHGVKPYLCYQLEQFNGQAPLKGCLLSEKGKQ

*HAEILFLDKIRSMELSQVIITCYLTWSPCPNC*AWQLAAFKRDRPDLILHIYTSRLYFHWKRPFQKGLCSLWQSG

ILVDVMDLPQFTDCWTNFVNPKRPFWPWKGLEIISRRTQRRLHRIKESWGLQDLVNDFGNLQLGPPMS
(italic: nucleic acid editing domain)

Rhesus macaque APOBEC-3G (SEQ ID NO: 276)

MVEPMDPRTFVSNFNNRPILSGLNTVWLCCEVKTKDPSGPPLDAKIFQGKVYSKAKY*HPEMRFLRWFHKW*

*RQLHHDQEYKVTWYVSWSPCTRC*ANSVATFLAKDPKVTLTIFVARLYYFWKPDYQQALRILCQKRGGPHAT

-continued

```
MKIMNYNEFQDCWNKFVDGRGKPFKPRNNLPKHYTLLQATLGELLRHLMDPGTFTSNFNNKPWVSGQHE

TYLCYKVERLHNDTWVPLNQHRGFLRNQAPNIHGFPKGRHAELCFLDLIPFWKLDGQQYRWCFTSWSPCFS

CAQEMAKFISNNEHVSLCIFAARIYDDQGRYQEGLRALHRDGAKIAMMNYSEFEYCWDTFVDRQGRPFQP
WDGLDEHSQALSGRLRAI
(italic: nucleic acid editing domain; underline: cytoplasmic
localization signal)
```

Chimpanzee APOBEC-3G (SEQ ID NO: 277)

```
MKPHFRNPVERMYQDTFSDNFYNRPILSHRNTVWLCYEVKTKGPSRPPLDAKIFRGQVYSKLKYHPEMRF

FHWFSKWRKLHRDQEYEVTWYISWSPCTKCTRDVATFLAEDPKVTLTIFVARLYYFWDPDYQEALRSLCQKR

DGPRATMKIMNYDEFQHCWSKFVYSQRELFEPWNNLPKYYILLHIMLGEILRHSMDPPTFTSNFNNELWVR

GRHETYLCYEVERLHNDTWVLLNQRRGFLCNQAPHKHGFLEGRHAELCFLDVIPFWKLDLHQDYRWCFTS

WSPCFSCAQEMAKFISNNKHVSLCIFAARIYDDQGRCQEGLRTLAKAGAKISIMTYSEFKHCWDTFVDHQG

CPFQPWDGLEEHSQALSGRLRAILQNQGN
(italic: nucleic acid editing domain; underline:
cytoplasmic localization signal)
```

Green monkey APOBEC-3G (SEQ ID NO: 278)

```
MNPQIRNMVEQMEPDIFVYYFNNRPILSGRNTVWLCYEVKTKDPSGPPLDANIFQGKLYPEAKDHPEMKFL

HWFRKWRQLHRDQEYEVTWYVSWSPCTRCANSVATFLAEDPKVTLTIFVARLYYFWKPDYQQALRILCQER

GGPHATMKIMNYNEFQHCWNEFVDGQGKPFKPRKNLPKHYTLLHATLGELLRHVMDPGTFTSNFNNKPW

VSGQRETYLCYKVERSHNDTWVLLNQHRGFLRNQAPDRHGFPKGRHAELCFLDLIPFWKLDDQQYRVTCFT

SWSPCFSCAQKMAKFISNNKHVSLCIFAARIYDDQGRCQEGLRTLHRDGAKIAVMNYSEFEYCWDTFVDR

QGRPFQPWDGLDEHSQALSGRLRAI
(italic: nucleic acid editing domain; underline:
cytoplasmic localization signal)
```

Human APOBEC-3G (SEQ ID NO: 279)

```
MKPHFRNTVERMYRDTFSYNFYNRPILSRRNTVWLCYEVKTKGPSRPPLDAKIFRGQVYSELKYHPEMRFF

HWFSKWRKLHRDQEYEVTWYISWSPCTKCTRDMATFLAEDPKVTLTIFVARLYYFWDPDYQEALRSLCQKR

DGPRATMKIMNYDEFQHCWSKFVYSQRELFEPWNNLPKYYILLHIMLGEILRHSMDPPTFTFNFNNEPWVR

GRHETYLCYEVERMHNDTWVLLNQRRGFLCNQAPHKHGFLEGRHAELCFLDVIPFWKLDLDQDYRVTCFTS

WSPCFSCAQEMAKFISKNKHVSLCIFTARIYDDQGRCQEGLRTLAEAGAKISIMTYSEFKHCWDTFVDHQG

CPFQPWDGLDEHSQDLSGRLRAILQNQEN
(italic: nucleic acid editing domain; underline:
cytoplasmic localization signal)
```

Human APOBEC-3F (SEQ ID NO: 280)

```
MKPHFRNTVERMYRDTFSYNFYNRPILSRRNTVWLCYEVKTKGPSRPRLDAKIFRGQVYSQPEHHAEMCFL

SWFCGNQLPAYKCFQITWFVSWTPCPDCVAKLAEFLAEHPNVTLTISAARLYYWERDYRRALCRLSQAGA

RVKIMDDEEFAYCWENFVYSEGQPFMPWYKFDDNYAFLHRTLKEILRNPMEAMYPHIFYFHFKNLRKAY

GRNESWLCFTMEVVKHHSPVSWKRGVFRNQVDPETHCHAERCFLSWFCDDILSPNTNYEVTWYTSWSPCPE

CAGEVAEFLARHSNVNLTIFTARLYYFWDTDYQEGLRSLSQEGASVEIMGYKDFKYCWENFVYNDDEPFK

PWKGLKYNFLFLDSKLQEILE
(italic: nucleic acid editing domain)
```

Human APOBEC-3B (SEQ ID NO: 281)

```
MNPQIRNPMERMYRDTFYDNFENEPILYGRSYTWLCYEVKIKRGRSNLLWDTGVFRGQVYFKPQYHAEM

CFLSWFCGNQLPAYKCFQITWFVSWTPCPDCVAKLAEFLSEHPNVTLTISAARLYYWERDYRRALCRLSQA
```

-continued

GARVTIMDYEEFAYCWENFVYNEGQQFMPWYKFDENYAFLHRTLKEILRYLMDPDTFTFNFNNDPLVLRR

RQTYLCYEVERLDNGTWVLMDQHMGFLCNEAKNLLCGFY*GRHAELRFLDLVPSLQLDPAQIYRVTWFISWS*

*PCFSWGC*AGEVRAFLQENTHVRLRIFAARIYDYDPLYKEALQMLRDAGAQVSIMTYDEFEYCWDTFVYRQ

GCPFQPWDGLEEHSQALSGRLRAILQNGN
(italic: nucleic acid editing domain)

Human APOBEC-3C: (SEQ ID NO: 282)

MNPQIRNPMKAMYPGTFYFQFKNLWEANDRNETWLCFTVEGIKRRSVVSWKTGVFRNQVDSETH*CHAER*

*CFLSWFCDDILSPNTKYQVTWYTSWSPCPDC*AGEVAEFLARHSNVNLTIFTARLYYFQYPCYQEGLRSLSQEG

VAVEIMDYEDFKYCWENFVYNDNEPFKPWKGLKTNFRLLKRRLRESLQ
(italic: nucleic acid editing domain)

Human APOBEC-3A: (SEQ ID NO: 283)

MEASPASGPRHLMDPHIFTSNFNNGIGRHKTYLCYEVERLDNGTSVKMDQHRGFLHNQAKNLLCGFYGR*H*

*AELRFLDLVPSLQLDPAQIYRVTWFISWSPCFSWGC*AGEVRAFLQENTHVRLRIFAARIYDYDPLYKEALQML

RDAGAQVSIMTYDEFKHCWDTFVDHQGCPFQPWDGLDEHSQALSGRLRAILQNGN
(italic: nucleic acid editing domain)

Human APOBEC-3H: (SEQ ID NO: 284)

MALLTAETFRLQFNNKRRLRRPYYPRKALLCYQLTPQNGSTPTRGYFENKKKC*HAEICHNEIKSMGLDETQ*

*CYQVTCYLTWSPCSS*CAWELVDFIKAHDHLNLGIFASRLYYHWCKPQQKGLRLLCGSQVPVEVMGFPKFAD

CWENFVDHEKPLSFNPYKMLEELDKNSRAIKRRLERIKIPGVRAQGRYMDILCDAEV
(italic: nucleic acid editing domain)

Human APOBEC-3D (SEQ ID NO: 285)

MNPQIRNPMERMYRDTFYDNFENEPILYGRSYTWLCYEVKIKRGRSNLLWDTGVFRGPVLPKRQSNHRQE

VYFRFEN*HAEMCFLSWFCGNRLPANRRFQITWFVSWNPCLPC*VVKVTKFLAEHPNVTLTISAARLYYYRDRD

WRWVLLRLHKAGARVKIMDYEDFAYCWENFVCNEGQPFMPWYKFDDNYASLHRTLKEILRNPMEAMYP

HIFYFHFKNLLKACGRNESWLCFTMEVTKHHSAVFRKRGVFRNQVDPETHC*HAERCFLSWFCDDILSPNTN*

*YEVTWYTSWSPCPEC*AGEVAEFLARHSNVNLTIFTARLCYFWDTDYQEGLCSLSQEGASVKIMGYKDFVSC

WKNFVYSDDEPFKPWKGLQTNFRLLKRRLREILQ
(italic: nucleic acid editing domain)

Human APOBEC-1 (SEQ ID NO: 286)

MTSEKGPSTGDPTLRRRIEPWEFDVFYDPRELRKEACLLYEIKWGMSRKIWRSSGKNTTNHVEVNFIKKFTS

ERDFHPSMSCSITWFLSWSPCWECSQAIREFLSRHPGVTLVIYVARLFWHMDQQNRQGLRDLVNSGVTIQI

MRASEYYHCWRNFVNYPPGDEAHWPQYPPLWMMLYALELHCIILSLPPCLKISRRWQNHLTFFRLHLQNC

HYQTIPPHILLATGLIHPSVAWR

Mouse APOBEC-1 (SEQ ID NO: 287)

MSSETGPVAVDPTLRRRIEPHEFEVFFDPRELRK*ET*CLLYEINWGGRHSVWRHTSQNTSNHVEVNFLEKFTT

ERYFRPNTRCSITWFLSWSPCGECSRAITEFLSRHPYVTLFIYIARLYHHTDQRNRQGLRDLISSGVTIQIMTE

QEYCYCWRNFVNYPPSNEAYWPRYPHLWVKLYVLELYCIILGLPPCLKILRRKQPQLTFFTITLQTCHYQRI

PPHLLWATGLK

Rat APOBEC-1 (SEQ ID NO: 288)

MSSETGPVAVDPTLRRRIEPHEFEVFFDPRELRK*ET*CLLYEINWGGRHSIWRHTSQNTNKHVEVNFIEKFTTE

RYFCPNTRCSITWFLSWSPCGECSRAITEFLSRYPHVTLFIYIARLYHHADPRNRQGLRDLISSGVTIQIMTEQ

ESGYCWRNFVNYSPSNEAHWPRYPHLWVRLYVLELYCIILGLPPCLNILRRKQPQLTFFTIALQSCHYQRLP

PHILWATGLK

-continued

Petromyzon marinus CDA1 (pmCDA1)
(SEQ ID NO: 289)
MTDAEYVRIHEKLDIYTFKKQFFNNKKSVSHRCYVLFELKRRGERRACFWGYAVNKPQSGTERGIHAEIFSI

RKVEEYLRDNPGQFTINWYSSWSPCADCAEKILEWYNQELRGNGHTLKIWACKLYYEKNARNQIGLWNL

RDNGVGLNVMVSEHYQCCRKIFIQSSHNQLNENRWLEKTLKRAEKRRSELSIMIQVKILHTTKSPAV

Human APOBEC3G D316R D317R
(SEQ ID NO: 290)
MKPHFRNTVERMYRDTFSYNFYNRPILSRRNTVWLCYEVKTKGPSRPPLDAKIFRGQVYSELKYHPEMRFF

HWFSKWRKLHRDQEYEVTWYISWSPCTKCTRDMATFLAEDPKVTLTIFVARLYYFWDPDYQEALRSLCQ

KRDGPRATMKIMNYDEFQHCWSKFVYSQRELFEPWNNLPKYYILLHIMLGEILRHSMDPPTFTFNFNNEPW

VRGRHETYLCYEVERMHNDTWVLLNQRRGFLCNQAPHKHGFLEGRHAELCFLDVIPFWKLDLDQDYRVT

CFTSWSPCFSCAQEMAKFISKNKHVSLCIFTARIYRRQGRCQEGLRTLAEAGAKISIMTYSEFKHCWDTFVD

HQGCPFQPWDGLDEHSQDLSGRLRAILQNQEN

Human APOBEC3G chain A
(SEQ ID NO: 291)
MDPPTFTFNFNNEPWVRGRHETYLCYEVERMHNDTWVLLNQRRGFLCNQAPHKHGFLEGRHAELCFLDV

IPFWKLDLDQDYRVTCFTSWSPCFSCAQEMAKFISKNKHVSLCIFTARIYDDQGRCQEGLRTLAEAGAKISI

MTYSEFKHCWDTFVDHQGCPFQPWDGLDEHSQDLSGRLRAILQ

Human APOBEC3G chain A D120R_D121R
(SEQ ID NO: 292)
MDPPTFTFNFNNEPWVRGRHETYLCYEVERMHNDTWVLLNQRRGFLCNQAPHKHGFLEGRHAELCFLDV

IPFWKLDLDQDYRVTCFTSWSPCFSCAQEMAKFISKNKHVSLCIFTARIYRRQGRCQEGLRTLAEAGAKISI

MTYSEFKHCWDTFVDHQGCPFQPWDGLDEHSQDLSGRLRAILQ

Non-Limiting Examples of Fusion Proteins/Nucleobase Editors are Provided.

His$_6$-rAPOBEC1-XTEN-dCas9 for Escherichia coli expression
(SEQ ID NO: 293)
MGSSHHHHHHMSSETGPVAVDPTLRRRIEPHEFEVFFDPRELRKETCLLYEINWGGRHSIWRHTSQNTNKH

VEVNFIEKFTTERYFCPNTRCSITWFLSWSPCGECSRAITEFLSRYPHVTLFIYIARLYHHADPRNRQGLRDLI

SSGVTIQIMTEQESGYCWRNFVNYSPSNEAHWPRYPHLWVRLYVLELYCIILGLPPCLNILRRKQPQLTFFTI

ALQSCHYQRLPPHILWATGLKSGSETPGTSESATPESDKKYSIGLAIGTNSVGWAVITDEYKVPSKKFKVLG

NTDRHSIKKNLIGALLFDSGETALATRLKRTARRRYTRRKNRICYLQEIFSNEMAKVDDSFFHRLEESFLVE

EDKKHERHPIFGNIVDEVAYHEKYPTIYHLRKKLVDSTDKADLRLIYLALAHMIKFRGHFLIEGDLNPDNSD

VDKLFIQLVQTYNQLFEENPINASGVDAKAILSARLSKSRRLENLIAQLPGEKKNGLFGNLIALSLGLTPNFK

SNFDLAEDAKLQLSKDTYDDDLDNLLAQIGDQYADLFLAAKNLSDAILLSDILRVNTEITKAPLSASMIKRY

DEHHQDLTLLKALVRQQLPEKYKEIFFDQSKNGYAGYIDGGASQLEFYKFIKPILEKMDGTEELLVKLNRE

DLLRKQRTFDNGSIPHQIHLGELHAILRRQEDFYPFLKDNREKIEKILTFRIPYYVGPLARGNSRFAWMTRKS

EETITPWNFEEVVDKGASAQSFIERMTNFDKNLPNEKVLPKHSLLYEYFTVYNELTKVKYVTEGMRKPAFL

SGEQKKAIVDLLFKTNRKVTVKQLKEDYFKKIECFDSVEISGVEDRFNASLGTYHDLLKIIKDKDFLDNEEN

EDILEDIVLTLTLFEDREMIEERLKTYAHLFDDKVMKQLKRRRYTGWGRLSRKLINGIRDKQSGKTILDFLK

SDGFANRNFMQLIHDDSLTFKEDIQKAQVSGQGDSLHEHIANLAGSPAIKKGILQTVKVVDELVKVMGRH

KPENIVIEMARENQTTQKGQKNSRERMKRIEEGIKELGSQILKEHPVENTQLQNEKLYLYYLQNGRDMYVD

QELDINRLSDYDVDAIVPQSFLKDDSIDNKVLTRSDKNRGKSDNVPSEEVVKKMKNYWRQLLNAKLITQR

KFDNLTKAERGGLSELDKAGFIKRQLVETRQITKHVAQILDSRMNTKYDENDKLIREVKVITLKSKLVSDFR

KDFQFYKVREINNYHHAHDAYLNAVVGTALIKKYPKLESEFVYGDYKVYDVRKMIAKSEQEIGKATAKYF

```
FYSNIMNFFKTEITLANGEIRKRPLIETNGETGEIVWDKGRDFATVRKVLSMPQVNIVKKTEVQTGGFSKESI
LPKRNSDKLIARKKDWDPKKYGGFDSPTVAYSVLVVAKVEKGKSKKLKSVKELLGITIMERSSFEKNPIDF
LEAKGYKEVKKDLIIKLPKYSLFELENGRKRMLASAGELQKGNELALPSKYVNFLYLASHYEKLKGSPEDN
EQKQLFVEQHKHYLDEIIEQISEFSKRVILADANLDKVLSAYNKHRDKPIREQAENIIHLFTLTNLGAPAAFK
YFDTTIDRKRYTSTKEVLDATLIHQSITGLYETRIDLSQLGGDSGGSPKKKRKV
``` rAPOBEC1-XTEN-dCas9-NLS for Mammalian expression (SEQ ID NO: 294)

```
MSSETGPVAVDPTLRRRIEPHEFEVFFDPRELRKETCLLYEINWGGRHSIWRHTSQNTNKHVEVNFIEKFTT
ERYFCPNTRCSITWFLSWSPCGECSRAITEFLSRYPHVTLFIYIARLYHHADPRNRQGLRDLISSGVTIQIMTE
QESGYCWRNFVNYSPSNEAHWPRYPHLWVRLYVLELYCIILGLPPCLNILRRKQPQLTFFTIALQSCHYQRL
PPHILWATGLKSGSETPGTSESATPESDKKYSIGLAIGTNSVGWAVITDEYKVPSKKFKVLGNTDRHSIKKN
LIGALLFDSGETAEATRLKRTARRRYTRRKNRICYLQEIFSNEMAKVDDSFFHRLEESFLVEEDKKHERHPIF
GNIVDEVAYHEKYPTIYHLRKKLVDSTDKADLRLIYLALAHMIKFRGHFLIEGDLNPDNSDVDKLFIQLVQT
YNQLFEENPINASGVDAKAILSARLSKSRRLENLIAQLPGEKKNGLFGNLIALSLGLTPNFKSNFDLAEDAKL
QLSKDTYDDDLDNLLAQIGDQYADLFLAAKNLSDAILLSDILRVNTEITKAPLSASMIKRYDEHHQDLTLLK
ALVRQQLPEKYKEIFFDQSKNGYAGYIDGGASQLEFYKFIKPILEKMDGTEELLVKLNREDLLRKQRTFDN
GSIPHQIHLGELHAILRRQEDFYPFLKDNREKIEKILTFRIPYYVGPLARGNSRFAWMTRKSEETITPWNFEEV
VDKGASAQSFIERMTNFDKNLPNEKVLPKHSLLYEYFTVYNELTKVKYVTEGMRKPAFLSGEQKKAIVDL
LFKTNRKVTVKQLKEDYFKKIECFDSVEISGVEDRFNASLGTYHDLLKIIKDKDFLDNEENEDILEDIVLTLT
LFEDREMIEERLKTYAHLFDDKVMKQLKRRRYTGWGRLSRKLINGIRDKQSGKTILDFLKSDGFANRNFM
QLIHDDSLTFKEDIQKAQVSGQGDSLHEHIANLAGSPAIKKGILQTVKVVDELVKVMGRHKPENIVIEMARE
NQTTQKGQKNSRERMKRIEEGIKELGSQILKEHPVENTQLQNEKLYLYYLQNGRDMYVDQELDINRLSDY
DVDAIVPQSFLKDDSIDNKVLTRSDKNRGKSDNVPSEEVVKKMKNYWRQLLNAKLITQRKFDNLTKAERG
GLSELDKAGFIKRQLVETRQITKHVAQILDSRMNTKYDENDKLIREVKVITLKSKLVSDFRKDFQFYKVREI
NNYHHAHDAYLNAVVGTALIKKYPKLESEFVYGDYKVYDVRKMIAKSEQEIGKATAKYFFYSNIMNFFKT
EITLANGEIRKRPLIETNGETGEIVWDKGRDFATVRKVLSMPQVNIVKKTEVQTGGFSKESILPKRNSDKLIA
RKKDWDPKKYGGFDSPTVAYSVLVVAKVEKGKSKKLKSVKELLGITIMERSSFEKNPIDFLEAKGYKEVK
KDLIIKLPKYSLFELENGRKRMLASAGELQKGNELALPSKYVNFLYLASHYEKLKGSPEDNEQKQLFVEQH
KHYLDEIIEQISEFSKRVILADANLDKVLSAYNKHRDKPIREQAENIIHLFTLTNLGAPAAFKYFDTTIDRKRY
TSTKEVLDATLIHQSITGLYETRIDLSQLGGDSGGSPKKKRKV
``` hAPOBEC1-XTEN-dCas9-NLS for Mammalian expression (SEQ ID NO: 295)

```
MTSEKGPSTGDPTLRRRIEPWEFDVFYDPRELRKEACLLYEIKWGMSRKIWRSSGKNTTNHVEVNFIKKFTS
ERDFHPSMSCSITWFLSWSPCWECSQAIREFLSRHPGVTLVIYVARLFWHMDQQNRQGLRDLVNSGVTIQI
MRASEYYHCWRNFVNYPPGDEAHWPQYPPLWMMLYALELHCIILSLPPCLKISRRWQNHLTFFRLHLQNC
HYQTIPPHILLATGLIHPSVAWRSGSETPGTSESATPESDKKYSIGLAIGTNSVGWAVITDEYKVPSKKFKVL
GNTDRHSIKKNLIGALLFDSGETALATRLKRTARRRYTRRKNRICYLQEIFSNEMAKVDDSFFHRLEESFLV
EEDKKHERHPIFGNIVDEVAYHEKYPTIYHLRKKLVDSTDKADLRLIYLALAHMIKFRGHFLIEGDLNPDNS
DVDKLFIQLVQTYNQLFEENPINASGVDAKAILSARLSKSRRLENLIAQLPGEKKNGLFGNLIALSLGLTPNF
KSNFDLAEDAKLQLSKDTYDDDLDNLLAQIGDQYADLFLAAKNLSDAILLSDILRVNTEITKAPLSASMIKR
YDEHHQDLTLLKALVRQQLPEKYKEIFFDQSKNGYAGYIDGGASQLEFYKFIKPILEKMDGTEELLVKLNR
EDLLRKQRTFDNGSIPHQIHLGELHAILRRQEDFYPFLKDNREKIEKILTFRIPYYVGPLARGNSRFAWMTRK
```

-continued

SEETITPWNFEEVVDKGASAQSFIERMTNFDKNLPNEKVLPKHSLLYEYFTVYNELTKVKYVTEGMRKPAF

LSGEQKKAIVDLLFKTNRKVTVKQLKEDYFKKIECFDSVEISGVEDRFNASLGTYHDLLKIIKDKDFLDNEE

NEDILEDIVLTLTLFEDREMIEERLKTYAHLFDDKVMKQLKRRRYTGWGRLSRKLINGIRDKQSGKTILDFL

KSDGFANRNFMQLIHDDSLTFKEDIQKAQVSGQGDSLHEHIANLAGSPAIKKGILQTVKVVDELVKVMGR

HKPENIVIEMARENQTTQKGQKNSRERMKRIEEGIKELGSQILKEHPVENTQLQNEKLYLYYLQNGRDMYV

DQELDINRLSDYDVDAIVPQSFLKDDSIDNKVLTRSDKNRGKSDNVPSEEVVKKMKNYWRQLLNAKLITQ

RKFDNLTKAERGGLSELDKAGFIKRQLVETRQITKHVAQILDSRMNTKYDENDKLIREVKVITLKSKLVSDF

RKDFQFYKVREINNYHHAHDAYLNAVVGTALIKKYPKLESEFVYGDYKVYDVRKMIAKSEQEIGKATAK

YFFYSNIMNFFKTEITLANGEIRKRPLIETNGETGEIVWDKGRDFATVRKVLSMPQVNIVKKTEVQTGGFSK

ESILPKRNSDKLIARKKDWDPKKYGGFDSPTVAYSVLVVAKVEKGKSKKLKSVKELLGITIMERSSFEKNPI

DFLEAKGYKEVKKDLIIKLPKYSLFELENGRKRMLASAGELQKGNELALPSKYVNFLYLASHYEKLKGSPE

DNEQKQLFVEQHKHYLDEIIEQISEFSKRVILADANLDKVLSAYNKHRDKPIREQAENIIHLFTLTNLGAPAA

FKYFDTTIDRKRYTSTKEVLDATLIHQSITGLYETRIDLSQLGGDSGGSPKKKRKV rAPOBEC1-XTEN-dCas9-UGI-NLS
(SEQ ID NO: 296)
MSSETGPVAVDPTLRRRIEPHEFEVFFDPRELRKETCLLYEINWGGRHSIWRHTSQNTNKHVEVNFIEKFTT

ERYFCPNTRCSITWFLSWSPCGECSRAITEFLSRYPHVTLFIYIARLYHHADPRNRQGLRDLISSGVTIQIMTE

QESGYCWRNFVNYSPSNEAHWPRYPHLWVRLYVLELYCIILGLPPCLNILRRKQPQLTFFTIALQSCHYQRL

PPHILWATGLKSGSETPGTSESATPESDKKYSIGLAIGTNSVGWAVITDEYKVPSKKFKVLGNTDRHSIKKN

LIGALLFDSGETAEATRLKRTARRRYTRRKNRICYLQEIFSNEMAKVDDSFFHRLEESFLVEEDKKHERHPIF

GNIVDEVAYHEKYPTIYHLRKKLVDSTDKADLRLIYLALAHMIKFRGHFLIEGDLNPDNSDVDKLFIQLVQT

YNQLFEENPINASGVDAKAILSARLSKSRRLENLIAQLPGEKKNGLFGNLIALSLGLTPNFKSNFDLAEDAKL

QLSKDTYDDDLDNLLAQIGDQYADLFLAAKNLSDAILLSDILRVNTEITKAPLSASMIKRYDEHHQDLTLLK

ALVRQQLPEKYKEIFFDQSKNGYAGYIDGGASQLEFYKFIKPILEKMDGTEELLVKLNREDLLRKQRTFDN

GSIPHQIHLGELHAILRRQEDFYPFLKDNREKIEKILTFRIPYYVGPLARGNSRFAWMTRKSEETITPWNFEEV

VDKGASAQSFIERMTNFDKNLPNEKVLPKHSLLYEYFTVYNELTKVKYVTEGMRKPAFLSGEQKKAIVDL

LFKTNRKVTVKQLKEDYFKKIECFDSVEISGVEDRFNASLGTYHDLLKIIKDKDFLDNEENEDILEDIVLTLT

LFEDREMIEERLKTYAHLFDDKVMKQLKRRRYTGWGRLSRKLINGIRDKQSGKTILDFLKSDGFANRNFM

QLIHDDSLTFKEDIQKAQVSGQGDSLHEHIANLAGSPAIKKGILQTVKVVDELVKVMGRHKPENIVIEMARE

NQTTQKGQKNSRERMKRIEEGIKELGSQILKEHPVENTQLQNEKLYLYYLQNGRDMYVDQELDINRLSDY

DVDAIVPQSFLKDDSIDNKVLTRSDKNRGKSDNVPSEEVVKKMKNYWRQLLNAKLITQRKFDNLTKAERG

GLSELDKAGFIKRQLVETRQITKHVAQILDSRMNTKYDENDKLIREVKVITLKSKLVSDFRKDFQFYKVREI

NNYHHAHDAYLNAVVGTALIKKYPKLESEFVYGDYKVYDVRKMIAKSEQEIGKATAKYFFYSNIMNFFKT

EITLANGEIRKRPLIETNGETGEIVWDKGRDFATVRKVLSMPQVNIVKKTEVQTGGFSKESILPKRNSDKLIA

RKKDWDPKKYGGFDSPTVAYSVLVVAKVEKGKSKKLKSVKELLGITIMERSSFEKNPIDFLEAKGYKEVK

KDLIIKLPKYSLFELENGRKRMLASAGELQKGNELALPSKYVNFLYLASHYEKLKGSPEDNEQKQLFVEQH

KHYLDEIIEQISEFSKRVILADANLDKVLSAYNKHRDKPIREQAENIIHLFTLTNLGAPAAFKYFDTTIDRKRY

TSTKEVLDATLIHQSITGLYETRIDLSQLGGDSGGSTNLSDIIEKETGKQLVIQESILMLPEEVEEVIGNKPESD

ILVHTAYDESTDENVMLLTSDAPEYKPWALVIQDSNGENKIKMLSGGSPKKKRKV rAPOBEC1-XTEN-Cas9 nickase-UGI-NLS
(BE3, SEQ ID NO: 297)
MSSETGPVAVDPTLRRRIEPHEFEVFFDPRELRKETCLLYEINWGGRHSIWRHTSQNTNKHVEVNFIEKFTT

ERYFCPNTRCSITWFLSWSPCGECSRAITEFLSRYPHVTLFIYIARLYHHADPRNRQGLRDLISSGVTIQIMTE

-continued

QESGYCWRNFVNYSPSNEAHWPRYPHLWVRLYVLELYCIILGLPPCLNILRRKQPQLTFFTIALQSCHYQRL

PPHILWATGLKSGSETPGTSESATPESDKKYSIGLAIGTNSVGWAVITDEYKVPSKKFKVLGNTDRHSIKKN

LIGALLFDSGETAEATRLKRTARRRYTRRKNRICYLQEIFSNEMAKVDDSFFHRLEESFLVEEDKKHERHPIF

GNIVDEVAYHEKYPTIYHLRKKLVDSTDKADLRLIYLALAHMIKFRGHFLIEGDLNPDNSDVDKLFIQLVQT

YNQLFEENPINASGVDAKAILSARLSKSRRLENLIAQLPGEKKNGLFGNLIALSLGLTPNFKSNFDLAEDAKL

QLSKDTYDDDLDNLLAQIGDQYADLFLAAKNLSDAILLSDILRVNTEITKAPLSASMIKRYDEHHQDLTLLK

ALVRQQLPEKYKEIFFDQSKNGYAGYIDGGASQLEFYKFIKPILEKMDGTEELLVKLNREDLLRKQRTFDN

GSIPHQIHLGELHAILRRQEDFYPFLKDNREKIEKILTFRIPYYVGPLARGNSRFAWMTRKSEETITPWNFEEV

VDKGASAQSFIERMTNFDKNLPNEKVLPKHSLLYEYFTVYNELTKVKYVTEGMRKPAFLSGEQKKAIVDL

LFKTNRKVTVKQLKEDYFKKIECFDSVEISGVEDRFNASLGTYHDLLKIIKDKDFLDNEENEDILEDIVLTITL

FEDREMIEERLKTYAHLFDDKVMKQLKRRRYTGWGRLSRKLINGIRDKQSGKTILDFLKSDGFANRNFMQ

LIHDDSLTFKEDIQKAQVSGQGDSLHEHIANLAGSPAIKKGILQTVKVVDELVKVMGRHKPENIVIEMAREN

QTTQKGQKNSRERMKRIEEGIKELGSQILKEHPVENTQLQNEKLYLYYLQNGRDMYVDQELDINRLSDYD

VDHIVPQSFLKDDSIDNKVLTRSDKNRGKSDNVPSEEVVKKMKNYWRQLLNAKLITQRKFDNLTKAERGG

LSELDKAGFIKRQLVETRQITKHVAQILDSRMNTKYDENDKLIREVKVITLKSKLVSDFRKDFQFYKVREIN

NYHHAHDAYLNAVVGTALIKKYPKLESEFVYGDYKVYDVRKMIAKSEQEIGKATAKYFFYSNIMNFFKTE

ITLANGEIRKRPLIETNGETGEIVWDKGRDFATVRKVLSMPQVNIVKKTEVQTGGFSKESILPKRNSDKLIAR

KKDWDPKKYGGFDSPTVAYSVLVVAKVEKGKSKKLKSVKELLGITIMERSSFEKNPIDFLEAKGYKEVKK

DLI1KLPKYSLFELENGRKRMLASAGELQKGNELALPSKYVNFLYLASHYEKLKGSPEDNEQKQLFVEQHK

HYLDEI1EQISEFSKRVILADANLDKVLSAYNKHRDKPIREQAENI1HLFTLTNLGAPAAFKYFDTTIDRKRYT

STKEVLDATLIHQSITGLYETRIDLSQLGGDSGGSTNLSDIIEKETGKQLVIQESILMLPEEVEEVIGNKPESDI

LVHTAYDESTDENVMLLTSDAPEYKPWALVIQDSNGENKIKMLSGGSPKKKRKV pmCDA1-XTEN-dCas9-UGI (bacteria)

(SEQ ID NO: 298)
MTDAEYVRIHEKLDIYTFKKQFFNNKKSVSHRCYVLFELKRRGERRACFWGYAVNKPQSGTERGIHAEIFSI

RKVEEYLRDNPGQFTINWYSSWSPCADCAEKILEWYNQELRGNGHTLKIWACKLYYEKNARNQIGLWNL

RDNGVGLNVMVSEHYQCCRKIFIQSSHNQLNENRWLEKTLKRAEKRRSELSIMIQVKILHTTKSPAVSGSET

PGTSESATPESDKKYSIGLAIGTNSVGWAVITDEYKVPSKKFKVLGNTDRHSIKKNLIGALLFDSGETAEAT

RLKRTARRRYTRRKNRICYLQEIFSNEMAKVDDSFFHRLEESFLVEEDKKHERHPIFGNIVDEVAYHEKYPT

IYHLRKKLVDSTDKADLRLIYLALAHMIKFRGHFLIEGDLNPDNSDVDKLFIQLVQTYNQLFEENPINASGV

DAKAILSARLSKSRRLENLIAQLPGEKKNGLFGNLIALSLGLTPNFKSNFDLAEDAKLQLSKDTYDDDLDNL

LAQIGDQYADLFLAAKNLSDAILLSDILRVNTEITKAPLSASMIKRYDEHHQDLTLLKALVRQQLPEKYKEI

FFDQSKNGYAGYIDGGASQEEFYKFIKPILEKMDGTEELLVKLNREDLLRKQRTFDNGSIPHQIHLGELHAIL

RRQEDFYPFLKDNREKIEKILTFRIPYYVGPLARGNSRFAWMTRKSEETITPWNFEEVVDKGASAQSFIERM

TNFDKNLPNEKVLPKHSLLYEYFTVYNELTKVKYVTEGMRKPAFLSGEQKKAIVDLLFKTNRKVTVKQLK

EDYFKKIECFDSVEISGVEDRFNASLGTYHDLLKIIKDKDFLDNEENEDILEDIVLTLTLFEDREMIEERLKTY

AHLFDDKVMKQLKRRRYTGWGRLSRKLINGIRDKQSGKTILDFLKSDGFANRNFMQLIHDDSLTFKEDIQK

AQVSGQGDSLHEHIANLAGSPAIKKGILQTVKVVDELVKVMGRHKPENIVIEMARENQTTQKGQKNSRER

MKRIEEGIKELGSQILKEHPVENTQLQNEKLYLYYLQNGRDMYVDQELDINRLSDYDVDAIVPQSFLKDDSI

DNKVLTRSDKNRGKSDNVPSEEVVKKMKNYWRQLLNAKLITQRKFDNLTKAERGGLSELDKAGFIKRQL

VETRQITKHVAQILDSRMNTKYDENDKLIREVKVITLKSKLVSDFRKDFQFYKVREINNYHHAHDAYLNAV

-continued

VGTALIKKYPKLESEFVYGDYKVYDVRKMIAKSEQEIGKATAKYFFYSNIMNFFKTEITLANGEIRKRPLIET

NGETGEIVWDKGRDFATVRKVLSMPQVNIVKKTEVQTGGFSKESILPKRNSDKLIARKKDWDPKKYGGFD

SPTVAYSVLVVAKVEKGKSKKLKSVKELLGITIMERSSFEKNPIDFLEAKGYKEVKKDLIIKLPKYSLFELEN

GRKRMLASAGELQKGNELALPSKYVNFLYLASHYEKLKGSPEDNEQKQLFVEQHKHYLDEIIEQISEFSKR

VILADANLDKVLSAYNKHRDKPIREQAENIIHLFTLTNLGAPAAFKYFDTTIDRKRYTSTKEVLDATLIHQSI

TGLYETRIDLSQLGGDSGGSMTNLSDIIEKETGKQLVIQESILMLPEEVEEVIGNKPESDILVHTAYDESTDEN

VMLLTSDAPEYKPWALVIQDSNGENKIKML pmCDA1-XTEN-nCas9-UGI-NLS (mammalian construct) (SEQ ID NO: 299):
MTDAEYVRIHEKLDIYTFKKQFFNNKKSVSHRCYVLFELKRRGERRACFWGYAVNKPQSGTERGIHAEIFSI

RKVEEYLRDNPGQFTINWYSSWSPCADCAEKILEWYNQELRGNGHTLKIWACKLYYEKNARNQIGLWNL

RDNGVGLNVMVSEHYQCCRKIFIQSSHNQLNENRWLEKTLKRAEKRRSELSIMIQVKILHTTKSPAVSGSET

PGTSESATPESDKKYSIGLAIGTNSVGWAVITDEYKVPSKKFKVLGNTDRHSIKKNLIGALLFDSGETAEAT

RLKRTARRRYTRRKNRICYLQEIFSNEMAKVDDSFFHRLEESFLVEEDKKHERHPIFGNIVDEVAYHEKYPT

IYHLRKKLVDSTDKADLRLIYLALAHMIKFRGHFLIEGDLNPDNSDVDKLFIQLVQTYNQLFEENPINASGV

DAKAILSARLSKSRRLENLIAQLPGEKKNGLFGNLIALSLGLTPNFKSNFDLAEDAKLQLSKDTYDDDLDNL

LAQIGDQYADLFLAAKNLSDAILLSDILRVNTEITKAPLSASMIKRYDEHHQDLTLLKALVRQQLPEKYKEI

FFDQSKNGYAGYIDGGASQEEFYKFIKPILEKMDGTEELLVKLNREDLLRKQRTFDNGSIPHQIHLGELHAIL

RRQEDFYPFLKDNREKIEKILTFRIPYYVGPLARGNSRFAWMTRKSEETITPWNFEEVVDKGASAQSFIERM

TNFDKNLPNEKVLPKHSLLYEYFTVYNELTKVKYVTEGMRKPAFLSGEQKKAIVDLLFKTNRKVTVQLK

EDYFKKIECFDSVEISGVEDRFNASLGTYHDLLKIIKDKDFLDNEENEDILEDIVLTLTLFEDREMIEERLKTY

AHLFDDKVMKQLKRRRYTGWGRLSRKLINGIRDKQSGKTILDFLKSDGFANRNFMQLIHDDSLTFKEDIQK

AQVSGQGDSLHEHIANLAGSPAIKKGILQTVKVVDELVKVMGRHKPENIVIEMARENQTTQKGQKNSRER

MKRIEEGIKELGSQILKEHPVENTQLQNEKLYLYYLQNGRDMYVDQELDINRLSDYDVDHIVPQSFLKDDSI

DNKVLTRSDKNRGKSDNVPSEEVVKKMKNYWRQLLNAKLITQRKFDNLTKAERGGLSELDKAGFIKRQL

VETRQITKHVAQILDSRMNTKYDENDKLIREVKVITLKSKLVSDFRKDFQFYKVREINNYHHAHDAYLNAV

VGTALIKKYPKLESEFVYGDYKVYDVRKMIAKSEQEIGKATAKYFFYSNIMNFFKTEITLANGEIRKRPLIET

NGETGEIVWDKGRDFATVRKVLSMPQVNIVKKTEVQTGGFSKESILPKRNSDKLIARKKDWDPKKYGGFD

SPTVAYSVLVVAKVEKGKSKKLKSVKELLGITIMERSSFEKNPIDFLEAKGYKEVKKDLIIKLPKYSLFELEN

GRKRMLASAGELQKGNELALPSKYVNFLYLASHYEKLKGSPEDNEQKQLFVEQHKHYLDEIIEQISEFSKR

VILADANLDKVLSAYNKHRDKPIREQAENIIHLFTLTNLGAPAAFKYFDTTIDRKRYTSTKEVLDATLIHQSI

TGLYETRIDLSQLGGDSGGSTNLSDIIEKETGKQLVIQESILMLPEEVEEVIGNKPESDILVHTAYDESTDENV

MLLTSDAPEYKPWALVIQDSNGENKIKMLSGGSPKKKRV huAPOBEC3G-XTEN-dCas9-UGI (bacteria)
(SEQ ID NO: 300)
MDPPTFTFNFNNEPWVRGRHETYLCYEVERMHNDTWVLLNQRRGFLCNQAPHKHGFLEGRHAELCFLDV

IPFWKLDLDQDYRVTCFTSWSPCFSCAQEMAKFISKNKHVSLCIFTARIYDDQGRCQEGLRTLAEAGAKISI

MTYSEFKHCWDTFVDHQGCPFQPWDGLDEHSQDLSGRLRAILQSGSETPGTSESATPESDKKYSIGLAIGTN

SVGWAVITDEYKVPSKKFKVLGNTDRHSIKKNLIGALLFDSGETAEATRLKRTARRRYTRRKNRICYLQEIF

SNEMAKVDDSFFHRLEESFLVEEDKKHERHPIFGNIVDEVAYHEKYPTIYHLRKKLVDSTDKADLRLIYLAL

AHMIKFRGHFLIEGDLNPDNSDVDKLFIQLVQTYNQLFEENPINASGVDAKAILSARLSKSRRLENLIAQLPG

EKKNGLFGNLIALSLGLTPNFKSNFDLAEDAKLQLSKDTYDDDLDNLLAQIGDQYADLFLAAKNLSDAILL

SDILRVNTEITKAPLSASMIKRYDEHHQDLTLLKALVRQQLPEKYKEIFFDQSKNGYAGYIDGGASQEEFYK

-continued

FIKPILEKMDGTEELLVKLNREDLLRKQRTFDNGSIPHQIHLGELHAILRRQEDFYPFLKDNREKIEKILTFRIP

YYVGPLARGNSRFAWMTRKSEETITPWNFEEVVDKGASAQSFIERMTNFDKNLPNEKVLPKHSLLYEYFT

VYNELTKVKYVTEGMRKPAFLSGEQKKAIVDLLFKTNRKVTVKQLKEDYFKKIECFDSVEISGVEDRFNAS

LGTYHDLLKIIKDKDFLDNEENEDILEDIVLTLTLFEDREMIEERLKTYAHLFDDKVMKQLRRRYTGWGR

LSRKLINGIRDKQSGKTILDFLKSDGFANRNFMQLIHDDSLTFKEDIQKAQVSGQGDSLHEHIANLAGSPAIK

KGILQTVKVVDELVKVMGRHKPENIVIEMARENQTTQKGQKNSRERMKRIEEGIKELGSQILKEHPVENTQ

LQNEKLYLYYLQNGRDMYVDQELDINRLSDYDVDAIVPQSFLKDDSIDNKVLTRSDKNRGKSDNVPSEEV

VKKMKNYWRQLLNAKLITQRKFDNLTKAERGGLSELDKAGFIKRQLVETRQITKHVAQILDSRMNTKYDE

NDKLIREVKVITLKSKLVSDFRKDFQFYKVREINNYHHAHDAYLNAVVGTALIKKYPKLESEFVYGDYKV

YDVRKMIAKSEQEIGKATAKYFFYSNIMNFFKTEITLANGEIRKRPLIETNGETGEIVWDKGRDFATVRKVL

SMPQVNIVKKTEVQTGGFSKESILPKRNSDKLIARKKDWDPKKYGGFDSPTVAYSVLVVAKVEKGKSKKL

KSVKELLGITIMERSSFEKNPIDFLEAKGYKEVKKDLIIKLPKYSLFELENGRKRMLASAGELQKGNELALPS

KYVNFLYLASHYEKLKGSPEDNEQKQLFVEQHKHYLDEIIEQISEFSKRVILADANLDKVLSAYNKHRDKPI

REQAENIIHLFTLTNLGAPAAFKYFDTTIDRKRYTSTKEVLDATLIHQSITGLYETRIDLSQLGGDSGGSMTN

LSDIIEKETGKQLVIQESILMLPEEVEEVIGNKPESDILVHTAYDESTDENVMLLTSDAPEYKPWALVIQDSN

GENKIKML huAPOBEC3G-XTEN-nCas9-UGI-NLS (mammalian construct)

(SEQ ID NO: 301)

MDPPTFTFNFNNEPWVRGRHETYLCYEVERMHNDTWVLLNQRRGFLCNQAPHKHGFLEGRHAELCFLDV

IPFWKLDLDQDYRVTCFTSWSPCFSCAQEMAKFISKNKHVSLCIFTARIYDDQGRCQEGLRTLAEAGAKISI

MTYSEFKHCWDTFVDHQGCPFQPWDGLDEHSQDLSGRLRAILQSGSETPGTSESATPESDKKYSIGLAIGTN

SVGWAVITDEYKVPSKKFKVLGNTDRHSIKKNLIGALLFDSGETAEATRLKRTARRRYTRRKNRICYLQEIF

SNEMAKVDDSFFHRLEESFLVEEDKKHERHPIFGNIVDEVAYHEKYPTIYHLRKKLVDSTDKADLRLIYLAL

AHMIKFRGHFLIEGDLNPDNSDVDKLFIQLVQTYNQLFEENPINASGVDAKAILSARLSKSRRLENLIAQLPG

EKKNGLFGNLIALSLGLTPNFKSNFDLAEDAKLQLSKDTYDDDLDNLLAQIGDQYADLFLAAKNLSDAILL

SDILRVNTEITKAPLSASMIKRYDEHHQDLTLLKALVRQQLPEKYKEIFFDQSKNGYAGYIDGGASQEEFYK

FIKPILEKMDGTEELLVKLNREDLLRKQRTFDNGSIPHQIHLGELHAILRRQEDFYPFLKDNREKIEKILTFRIP

YYVGPLARGNSRFAWMTRKSEETITPWNFEEVVDKGASAQSFIERMTNFDKNLPNEKVLPKHSLLYEYFT

VYNELTKVKYVTEGMRKPAFLSGEQKKAIVDLLFKTNRKVTVKQLKEDYFKKIECFDSVEISGVEDRFNAS

LGTYHDLLKIIKDKDFLDNEENEDILEDIVLTLTLFEDREMIEERLKTYAHLFDDKVMKQLRRRYTGWGR

LSRKLINGIRDKQSGKTILDFLKSDGFANRNFMQLIHDDSLTFKEDIQKAQVSGQGDSLHEHIANLAGSPAIK

KGILQTVKVVDELVKVMGRHKPENIVIEMARENQTTQKGQKNSRERMKRIEEGIKELGSQILKEHPVENTQ

LQNEKLYLYYLQNGRDMYVDQELDINRLSDYDVDHIVPQSFLKDDSIDNKVLTRSDKNRGKSDNVPSEEV

VKKMKNYWRQLLNAKLITQRKFDNLTKAERGGLSELDKAGFIKRQLVETRQITKHVAQILDSRMNTKYDE

NDKLIREVKVITLKSKLVSDFRKDFQFYKVREINNYHHAHDAYLNAVVGTALIKKYPKLESEFVYGDYKV

YDVRKMIAKSEQEIGKATAKYFFYSNIMNFFKTEITLANGEIRKRPLIETNGETGEIVWDKGRDFATVRKVL

SMPQVNIVKKTEVQTGGFSKESILPKRNSDKLIARKKDWDPKKYGGFDSPTVAYSVLVVAKVEKGKSKKL

KSVKELLGITIMERSSFEKNPIDFLEAKGYKEVKKDLIIKLPKYSLFELENGRKRMLASAGELQKGNELALPS

KYVNFLYLASHYEKLKGSPEDNEQKQLFVEQHKHYLDEIIEQISEFSKRVILADANLDKVLSAYNKHRDKPI

REQAENIIHLFTLTNLGAPAAFKYFDTTIDRKRYTSTKEVLDATLIHQSITGLYETRIDLSQLGGDSGGSTNLS

DIIEKETGKQLVIQESILMLPEEVEEVIGNKPESDILVHTAYDESTDENVMLLTSDAPEYKPWALVIQDSNGE

NKIKMLSGGSPKKKRKV huAPOBEC3G (D316R_D317R)-XTEN-nCas9-UGI-NLS (mammalian construct)

(SEQ ID NO: 302)

MDPPTFTFNFNNEPWVRGRHETYLCYEVERMHNDTWVLLNQRRGFLCNQAPHKHGFLEGRHAELCFLDV

IPFWKLDLDQDYRVTCFTSWSPCFSCAQEMAKFISKNKHVSLCIFTARIYRRQGRCQEGLRTLAEAGAKISI

MTYSEFKHCWDTFVDHQGCPFQPWDGLDEHSQDLSGRLRAILQSGSETPGTSESATPESDKKYSIGLAIGTN

SVGWAVITDEYKVPSKKFKVLGNTDRHSIKKNLIGALLFDSGETALATRLKRTARRRYTRRKNRICYLQEIF

SNEMAKVDDSFFHRLEESFLVEEDKKHERHPIFGNIVDEVAYHEKYPTIYHLRKKLVDSTDKADLRLIYLAL

AHMIKFRGHFLIEGDLNPDNSDVDKLFIQLVQTYNQLFEENPINASGVDAKAILSARLSKSRRLENLIAQLPG

EKKNGLFGNLIALSLGLTPNFKSNFDLAEDAKLQLSKDTYDDDLDNLLAQIGDQYADLFLAAKNLSDAILL

SDILRVNTEITKAPLSASMIKRYDEHHQDLTLLKALVRQQLPEKYKEIFFDQSKNGYAGYIDGGASQLEFYK

FIKPILEKMDGTEELLVKLNREDLLRKQRTFDNGSIPHQIHLGELHAILRRQEDFYPFLKDNREKIEKILTFRIP

YYVGPLARGNSRFAWMTRKSEETITPWNFEEVVDKGASAQSFIERMTNFDKNLPNEKVLPKHSLLYEYFT

VYNELTKVKYVTEGMRKPAFLSGEQKKAIVDLLFKTNRKVTVKQLKEDYFKKIECFDSVEISGVEDRFNAS

LGTYHDLLKIIKDKDFLDNEENEDILEDIVLTLTLFEDREMIEERLKTYAHLFDDKVMKQLKRRRYTGWGR

LSRKLINGIRDKQSGKTILDFLKSDGFANRNFMQLIHDDSLTFKEDIQKAQVSGQGDSLHEHIANLAGSPAIK

KGILQTVKVVDELVKVMGRHKPENIVIEMARENQTTQKGQKNSRERMKRIEEGIKELGSQILKEHPVENTQ

LQNEKLYLYYLQNGRDMYVDQELDINRLSDYDVDHIVPQSFLKDDSIDNKVLTRSDKNRGKSDNVPSEEV

VKKMKNYWRQLLNAKLITQRKFDNLTKAERGGLSELDKAGFIKRQLVETRQITKHVAQILDSRMNTKYDE

NDKLIREVKVITLKSKLVSDFRKDFQFYKVREINNYHHAHDAYLNAVVGTALIKKYPKLESEFVYGDYKV

YDVRKMIAKSEQEIGKATAKYFFYSNIMNFFKTEITLANGEIRKRPLIETNGETGEIVWDKGRDFATVRKVL

SMPQVNIVKKTEVQTGGFSKESILPKRNSDKLIARKKDWDPKKYGGFDSPTVAYSVLVVAKVEKGKSKKL

KSVKELLGITIMERSSFEKNPIDFLEAKGYKEVKKDLIIKLPKYSLFELENGRKRMLASAGELQKGNELALPS

KYVNFLYLASHYEKLKGSPEDNEQKQLFVEQHKHYLDEIIEQISEFSKRVILADANLDKVLSAYNKHRDKPI

REQAENIIHLFTLTNLGAPAAFKYFDTTIDRKRYTSTKEVLDATLIHQSITGLYETRIDLSQLGGDSGGSTNLS

DIIEKETGKQLVIQESILMLPEEVEEVIGNKPESDILVHTAYDESTDENVMLLTSDAPEYKPWALVIQDSNGE

NKIKMLSGGSPKKKRKV

Figure 2A:
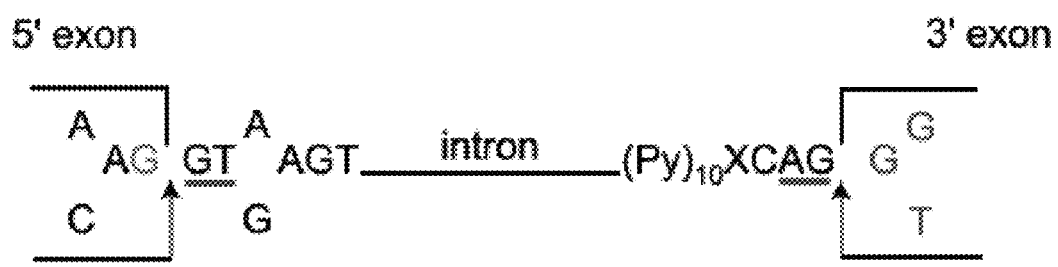

Example 2: Genome/Base-Editing Methods for Modifying the CCR5 Receptor Gene to Protect Against HIV Infection Disclosed herein are new ways for introducing novel engineered variants, as well as naturally-occurring allelic variants, of the co-receptor C—C Chemokine Receptor 5 (CCR5) that prevent or hinder cellular entry of the Human Immunodeficiency Virus (HIV). These methods include CRISPR-Cas9-based tools programmed by guide RNAs requiring either: (i) "base-editors" that catalyze chemical reactions on nucleobases (e.g., cytidine deaminase-Cas9 fusion, e.g. BE3[1]); (ii) an engineered nuclease with DNA cutting activity (e.g., WT Cas9,[2] Cas9 nickases[3] or Fok1-nuclease-dCas9 fusions[4]). The variants selected (FIG. 1, Tables 1-5) include residues that directly alter the affinity for the HIV coat protein and/or destabilize the CCR5 protein folding, which mimics the potentially curative effects of the CCR5Δ32 variant.[5] Using a similar strategy, the intron-exon splicing junction adjacent to the open-reading frame of CCR5 can be altered to prevent the maturation and/or destabilize the mRNA transcript (FIGS. 2A to 2C, Table 2).

Figure 5:
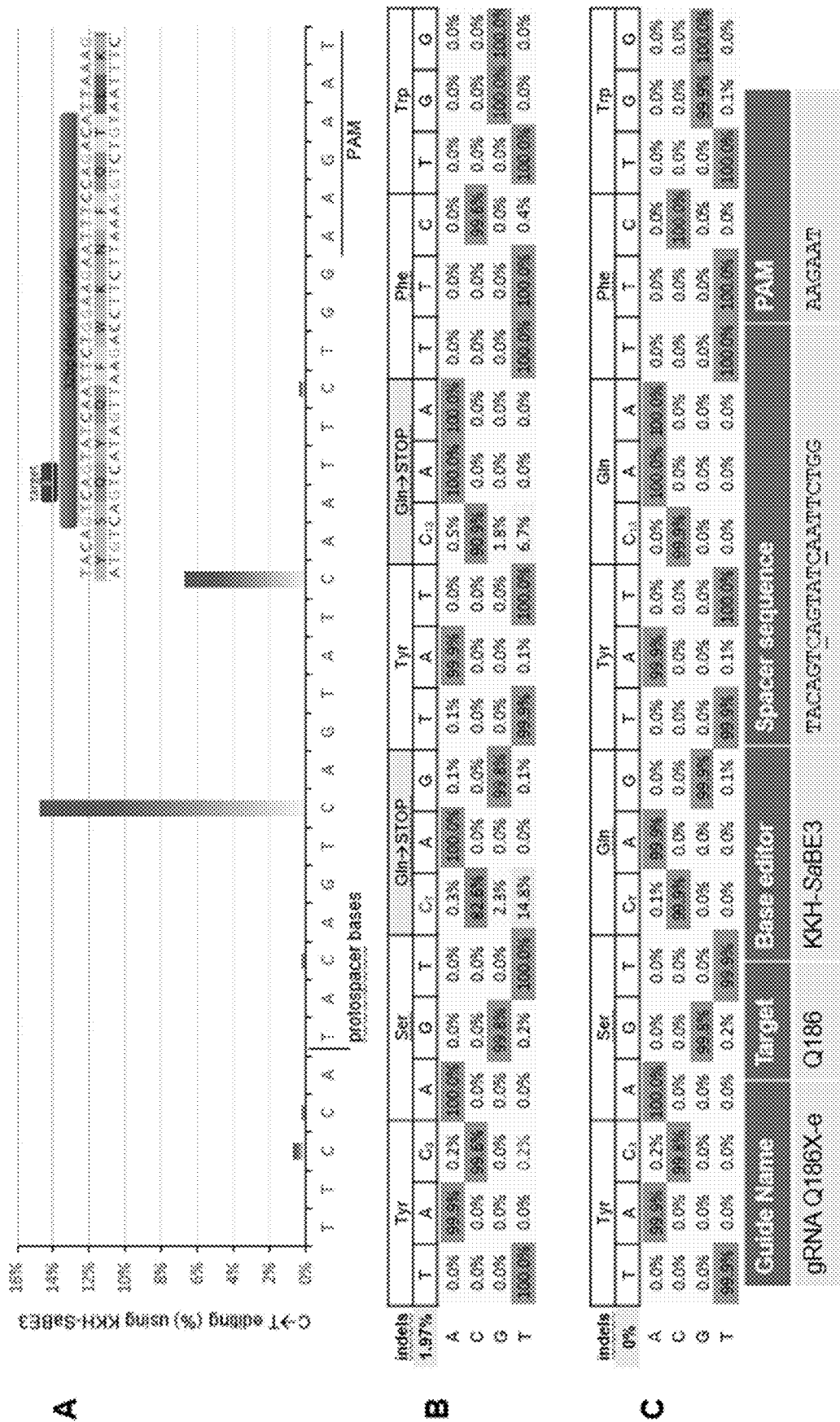

Subsequently, other natural protective variants may be identified in human populations that can be replicated in the same manner (FIG. 3, Tables 6 and 7). Moreover, new protective variants of CCR5 (Tables 8-10), and also CCR2,[6] could be identified by treating cells in vitro with guide-RNA libraries designed for all possible PAMs in these gene, coupled with FACS sorting using reporters/labeling methods and DNA-deep sequencing, to find the guide-RNAs that programmed base-editing reactions that lower CCR5 protein expression, prevent gp120 binding, and/or hinder HIV entry into the cell. For example, engineered alterations to destabilize CCR5 may follow a simple design of switching hydrophobic to polar residues on the transmembrane helices (FIG. 1). The precisely-targeted methods for CCR5 modifications proposed herein are complementary to previous methods that create random indels in the CCR5 genomic site using engineered nucleases such as CRISPR/Cas9, TALEN, or zinc-finger nucleases in hematopoietic cells ex vivo.[7] Moreover, "base-editors" such as BE3 may have a more favorable safety profile, due to the relatively low impact that off-target cytosine deamination has on genomic stability,[8] including oncogene activation or tumor suppressor in Example 3: Exemplary C to T Editing Demonstrating Modification of the CCR5 Receptor Gene to Generate Q186X and Q188X Stop Codons C to T editing of CCR5 was performed in HEK293 cells using KKH-SaBE3 and guide-RNA Q186X-e [spacer sequence TACAGTCAGTATCAATTCTGG (SEQ ID NO: 735); PAM sequence: AAGAAT (SEQ ID NO: 736)]. The results from these experiments are shown in FIG. 5, panels A-C. The editing was calculated from total reads (MiSeq).

FIG. 5, panel A demonstrates that significant editing was observed at position C7 and C13, both of which generate premature stop codons in tandem (Q186X and Q188X, see inset graphic of FIG. 5, panel A). The PAM sequence is shown as underlined and the last nucleotide of the protospacer is separated with a line. Raw data used for base-calling and calculating base-editing for KKH-BE3 and Q186X-e treated HEK293 cells is shown in FIG. 5, panel B. The indel percentage was 1.97%. FIG. 5, panel C shows raw data collected for untreated control cells.

TABLE 1

Introduction of HIV-protective naturally-occurring allelic variants of CCR5 and CCR2 using genome/base-editing with APOBEC1-Cas9 tools (e.g. BE3[1]).

| Known variant | Target codon | Genome-editing reaction(s) | Edited codon | Match/mimic | Predicted outcome (ref) |
|---|---|---|---|---|---|
| CCR5 (D2V) | GAT | $1^{st}$ base C → T on complementary strand | AAT | Asparagine (mimic) | Charge neutralized, unfolding, and destabilization[5c] |
| CCR5 (C20S) | TGC | $2^{nd}$ base C → T on complementary strand | TAC | Tyrosine (mimic) | Lack of major disulfide bridge, unfolding[5c] |
| CCR5 (C101X) | TGT | $2^{nd}$ base C → T on complementary strand | TAT | Tyrosine (mimic) | Lack of minor disulfide bridge, unfolding, destabilization[5c] |
| CCR5 (G106R) | GGG | $1^{st}$ base C → T on complementary strand | AGG | Arginine (match) | Transmembrane helix disruption, destabilization[5a, 5c] |
| CCR5 (C178R) | TGC | $2^{nd}$ base C → T on complementary strand | TAC | Tyrosine (mimic) | Lack of minor disulfide bridge, destabilization[5c] |
| CCR5 (R223Q) | CGG | $2^{nd}$ base C → T on complementary strand | CAG | Glutamine (match) | Charge neutralized, destabilization[5c] |
| CCR5 (C269F) | TGC | $2^{nd}$ base C → T on complementary strand | TAC | Tyrosine (mimic) | Lack of major disulfide bridge, unfolding, destabilization[5a, 5c] |
| CCR2 (A335V) | GCA | $2^{nd}$ base C → T on coding strand | GTA | Valine (match) | Hydrophobic patch, unfolding, destabilization[5c] |
| CCR2 (V64I) | GTC | $2^{nd}$ base C → T on complementary strand | TAA | Isoleucine (match) | Affects CCR5 stability[6] |

TABLE 2

Examples of genome-editing reactions to alter intron-exon junctions and the START site and produce non-functional CCR5 protein, mimicking the HIV protective effect of the CCR5-Δ32 allele.

| Target site | Consensus sequence | Method | Genome-editing reaction(s) | Edited sequence | Outcome |
|---|---|---|---|---|---|
| Intron donor | G-G-G-T-R-A-G-T | Base-editing | $2^{nd}$ or $3^{rd}$ base C → T on complementary strand | G-A-G-T-R-A-G-T (example) | Intron sequence is translated as exon, next TAG, TGA, or TAA sequence is used as STOP codon |
| Lariat branch point | T-T-G-T-A | Base-editing | $3^{th}$ base C → T on coding strand | T-T-A-T-A | The following exon is skipped from the mature mRNA, which may affect the coding frame |
| Intron acceptor | Y(rich)-A-C-A-G-G | Base-editing | $2^{nd}$ to last base C → T on complementary strand | Y(rich)-A-C-A-A-G | The exon is skipped from the mature mRNA, which may affect the coding frame |
| Start codon | ATG (Methionine) | Base-editing | $3^{rd}$ base C → T on complementary strand | ATA (Isoleucine) | The next ATG is used as start, which may affect the coding frame |

TABLE 2-continued

Examples of genome-editing reactions to alter intron-exon junctions and the START site and produce non-functional CCR5 protein, mimicking the HIV protective effect of the CCR5-Δ32 allele.

| Target site | Consensus sequence | Method | Genome-editing reaction(s) | Edited sequence | Outcome |
|---|---|---|---|---|---|
| Intron donor | G-G-G-T-R-A-G-T | Cas9 Nickase Fok-1 | random insertions and deletions due to NHEJ | indels | Intron sequence is translated as exon, next TAG, TGA, or TAA sequence is used as STOP codon |
| Lariat branch point | T-T-N-T-A | Cas9 Nickase Fok-1 | random insertions and deletions due to NHEJ | indels | The following exon is skipped from the mature mRNA, which may affect the coding frame |
| Intron acceptor | Y(rich)-A-C-A-G-G | Cas9 Nickase Fok-1 | random insertions and deletions due to NHEJ | indels | The exon is skipped from the mature mRNA, which may affect the coding frame |

TABLE 3

Guide-RNAs designed for introducing naturally-occurring HIV-protective variants of genome/base editing of CCR5 using base-editor BE3 or WT Cas9.

| Target variant | Target codon | Edited codon | Guide-RNA sequence | SEQ ID NO: | (PAM) | Size (C#) | GE/BE method |
|---|---|---|---|---|---|---|---|
| CCR5 (D2N) | GAT | AAT | UAAUCCAUCUUGUUCCACCC | 381 | (TGTG) | 20 (C5) | VRER-SpBE3 |
| | | | CCAUCUUGUUCCACCCUGUGC | 382 | (ATAAAT) | 21 (C-1) | KKH-SaBE3 |
| CCR5 (C20Y) | TGC | TAC | CAGGGCUCCGAUGUAUAAUA | 383 | (ATTGAT) | 20 (C1) | KKH-SaBE3 |
| | | | UUGGCAGGGCUCCGAUGUAU | 384 | (AATAAT) | 20 (C5) | KKH-SaBE3 |
| CCR5 (C101Y) | TGT | TAT | GUUGACACAUUGUAUUCCA | 385 | (AAG) | 20 (C6) | SpBE3 |
| | | | GAGUUGACACAUUGUAUUUC | 386 | (CAAAGT) | 20 (C8) | KKH-SaBE3 |
| CCR5 (G106R) | GGG | AGG | AUAAAAUAGAGCCCUGUCAA | 387 | (GAG) | 20 (C13) | VQR-SpBE3 |
| CCR5 (C178Y) | TGC | TAC | UGAGAGCUGCAGGUGUAAUG | 388 | (AAG) | 20 (C10) | SpBE3 |
| | | | GAGAGCUGCAGGUGUAAUGA | 389 | (AGA) | 20 (C9) | VQR-SpBE3 |
| CCR5 (R223Q) | CGG | CAG | CGACACCGAAGCAGAGUUUU | 390 | (TAG) | 20 (C7) | SpBE3 |
| | | | GACACCGAAGCAGAGUUUUU | 391 | (AGG) | 20 (C6) | SpBE3 |
| | | | ACACCGAAGCAGAGUUUUUA | 392 | (GGA) | 20 (C5) | VQR-SpBE3 |
| | | | CGACACCGAAGCAGAGUUUU | 393 | (TAGGAT) | 20 (C7) | SaBE3 |
| | | | CGAAGCAGAGUUUUUAGGAUUC | 394 | (CCGAGT) | 22 (C-2) | SaBE3 |
| CCR5 (C269Y) | TGC | TAC | UACUGCAAUUAUUCAGGCCA | 395 | (AAG) | 20 (C6) | SpBE3 |
| | | | ACUGCAAUUAUUCAGGCCAA | 396 | (AGA) | 20 (C5) | VQR-SpBE3 |
| | | | UACUGCAAUUAUUCAGGCCA | 397 | (AAGAAT) | 20 (C6) | SaBE3 |
| splicing acceptor site | CAGG | CAAG | CCACCCUGUGCAUAAAUAAA | 398 | (AAG) | 20 (C6/5) | SpBE3 |
| | | | CCCUGUGCAUAAAUAAAAG | 399 | (TGA) | 20 (C3/2) | VQR-SpBE3 |
| | | | CACCCUGUGCAUAAAUAAAA | 400 | (AGTG) | 20 (C5/4) | VRER-SpBE3 |
| | | | CACCCUGUGCAUAAAUAAAA | 401 | (AGTGAT) | 20 (C5/4) | KKH-SaBE3 |
| | | | UUCCACCCUGUGCAUAAAUAUUUAUGC | 402 | (AAAAGT) | 20 (C7/8) | KKH-SaBE3VQR-SpBE3 |
| | | | ACAGGGUGGAACA | 403 | (AGAT) | 20 (C9) | |
| | | | UGCACAGGGUGGAACAAGAU | 404 | (GGAT) | 20 (C5) | VQR-SpBE3 |
| | | | AUUUAUGCACAGGGUGGAAC | 405 | (AAG) | 20 (C10) | VQR-SpBE3 |
| | | | AUGCACAGGGUGGAACAAGA | 406 | (TGG) | 20 (C6) | SpBE3 SpBE3 |

TABLE 3-continued

Guide-RNAs designed for introducing naturally-occurring HIV-protective variants of genome/base editing of CCR5 using base-editor BE3 or WT Cas9.

| Target variant | Target codon | Edited codon | Guide-RNA sequence | SEQ ID NO: | (PAM) | Size (C#) | GE/BE method |
|---|---|---|---|---|---|---|---|
| splicing branch point | RTNA | indels | GAGGGCAACUAAAUACAUUC | 407 | (TAG) | 20 | WT SpCas9 |
| | | | AGGGCAACUAAAUACAUUCU | 408 | (AGG) | 20 | WT SpCas9 |
| | | | AAACUGUUUUAUACAUCAAU | 409 | (AGG) | 20 | WT SpCas9 |
| | | | CAAACUGUUUUAUACAUCAA | 410 | (TAG) | 20 | WT SpCas9 |

Base editors:
SpBE3 = APOBEC1-SpCas9n-UGI;
VQR-SpBE3 = APOBEC1-VQR-SpCas9n-UGI;
EQR-SpBE3 = APOBEC1-EQR-SpCas9n-UGI;
VRER-SpBE3 = APOBEC1-VRER-SpCas9n-UGI;
SaBE3 = APOBEC1-SaCas9n-UGI;
KKH-SaBE3 = APOBEC1-KKH-SaCas9n-UGI.

TABLE 4

Guide-RNAs designed for engineering new HIV-protective variants of genome/base editing of CCR5 using base-editor BE3.

| Target variant(s) | Target codon | Edited codon | Guide-RNA sequence | SEQ ID NO: | (PAM) | Size (C#) | GE/BE method |
|---|---|---|---|---|---|---|---|
| P195/L | CCC | TCC | CCCUGCCAAAAAUCAAUGUG | 411 | (AAG) | 21 (C1/-1) | SpBE3 |
| | or | CCUGCCAAAAAUCAAUGUG | 412 | (AAG) | 20 (C1) | SpBE3 |
| | | CTC | GAGCCCUGCCAAAAAUCAA | 413 | (TGTG) | 20 (C5/6) | VQR-SpBE3 |
| | | | GCCCUGCCAAAAAUCAAUG | 414 | (TGAA) | 20 (C2/3) | VQR-SpBE3 |
| | | | UAUACAUCGGAGCCCUGCCA | 415 | (AAAAAT) | 20 (C13) | KKH-SaBE3 |
| | | | CAUCGGAGCCCUGCCAAAAA | 416 | (ATCAAT) | 20 (C9/10) | KKH-SaBE3 |
| P34S/L | CCT | TCT | CCUGCCUCCGCUCUACUCAC | 417 | (TGG) | 20 (C5/6) | SpBE3 |
| | or | CTT | CUGCCUCCGCUCUACUCACU | 418 | (GGTG) | 20 (C4/5) | VQR-SpBE3 |
| | | | CUCCUGCCUCCGCUCUACUC | 419 | (ACTGGT) | 20 (C7/8) | KKH-SaBE3 |
| P35S/L | CCG | TCG | same as above for P34S/L | | | | |
| | or | CTG | | | | | |
| G44S/D | GGT | AGT | AACCAAAGAUGAACACCAGU | 420 | (GAG) | 20 (C3/4) | SpBE3 |
| | or | GAT | CAAAACCAAAGAUGAACACC | 421 | (AGTG) | 20 (C5/6) | VQR-SpBE3 |
| | | | ACAAAACCAAAGAUGAACAC | 422 | (CAG) | 20 (C7/8) | SpBE3 |
| | | | AAAACCAAAGAUGAACACCA | 423 | (GTGAGT) | 20 (C5/6) | SaBE3 |
| | | | CCACAAAACCAAAGAUGAAC | 424 | (ACCAGT) | 20 (C9/10) | KKH-SaBE3 |
| G47S/D | GGC | AGC | GCAUGUUGCCCACAAAACCA | 425 | (AAG) | 20 (C9/10) | SpBE3 |
| | or | GAC | GUUGCCCACAAAACCAAAGA | 426 | (TGAA) | 20 (C5/6) | VQR-SpBE3 |
| | | | CAUGUUGCCCACAAAACCAA | 427 | (AGAT) | 20 (C8/9) | VQR-SpBE3 |
| | | | AGCAUGUUGCCCACAAAACC | 428 | (AAAGAT) | 20 (10/11) | KKH-SaBE3 |
| G111S/D | GGC | AGC | GAGAAGAAGCCUAUAAAAUA | 429 | (GAG) | 20 (C10) | SpBE3 |
| | or | GAC | CAGAGAAGAAGCCUAUAAAA | 430 | (TAG) | 20 (C12) | SpBE3 |
| G115R/E | GGA | AGA | CCAGAGAAGAAGCCUAUAAAAUGAAGA | 431 | (TAG) | 21 (C1/-1) | SpBE3 |
| | or | GAA | AGAUUCCAGAGAAG | 432 | (AAG) | 20 (C12) | SpBE3 |
| | | | GAUUCCAGAGAAGAAGCCUA | 433 | (TAAAAT) | 20 (C4/5) | KKH-SaBE3 |
| G145R/E | GGG | AGG | CACCCCAAAGGUGACCGUCC | 434 | (TGG) | 20 (C5/6) | SpBE3 |
| | or | GAG | | | | | |
| S149N | AGT | AAT | CACACUUGUCACCACCCCAA | 435 | (AGG) | 20 (C5) | SpBE3 |
| | | | UCACACUUGUCACCACCCCA | 436 | (AAG) | 20 (C6) | SpBE3 |
| | | | ACUUGUCACCACCCCAAAGG | 437 | (TGAC) | 20 (C2) | VQR-SpBE3 |
| | | | ACACUUGUCACCACCCCAAA | 438 | (GGTG) | 20 (C4) | VQR-SpBE3 |
| | | | AUCACACUUGUCACCACCCC | 439 | (AAAGGT) | 20 (C7) | KKH-SaBE3 |
| P162S/L | CCA | TCA | CUCCCAGGAAUCAUCUUUAC | 440 | (CAG) | 20 (C4/5) | SpBE3 |
| | or | CTA | UCCCAGGAAUCAUCUUUACC | 441 | (AGAT) | 20 (C3/4) | VQR-SpBE3 |
| | | | UCUCCCAGGAAUCAUCUUUA | 442 | (CCAGAT) | 20 (C5/6) | KKH-SaBE3 |
| G163R/E | GGA | AGA | UCCUGGGAGAGACGCAAACA | 443 | (CAG) | 20 (C3/2) | SpBE3 |
| | or | GAA | GUAAAGAUGAUUCCUGGGAG | 444 | (AGAC) | 20 (C13) | VQR-SpBE3 |

TABLE 4-continued

Guide-RNAs designed for engineering new HIV-protective variants of genome/base editing of CCR5 using base-editor BE3.

| Target variant(s) | Target codon | Edited codon | Guide-RNA sequence | SEQ ID NO: | (PAM) | Size (C#) | GE/BE method |
|---|---|---|---|---|---|---|---|
| P183S/L | CCA | TCA or CTA | CCAUACAGUCAGUAUCAAUUC | 445 | (TGG) | 21 (C1/-1) | SpBE3 |
| | | | CAUACAGUCAGUAUCAAUUC | 446 | (TGG) | 20 (C1) | SpBE3 |
| | | | GCUCUCAUUUUCCAUACAGU | 447 | (CAG) | 20 (C12) | SpBE3 |
| | | | UCAUUUUCCAUACAGUCAGU | 448 | (ATCAAT) | 20 (C8) | KKH-SaBE3 |
| G202R/E | GGG | AGG or GAG | UCAUUUUCCAUACAGUCAGU | 449 | (ATCAAT) | 20 (C6/C7) | KKH-SaBE3 |
| P206S/L | CCG | TCG or CTG | GGUCCUGCCGCUGCUUGUCA | 450 | (TGG) | 20 (c8/9) | SpBE3 |
| | | | CUGGUCCUGCCGCUGCUUGU | 451 | (CATGGT) | 20 (10/11) | KKH-SaBE3 |
| G216R/E | GGA | AGA or GAA | UCCCGAGUAGCAGAUGACCA | 452 | (TGAC) | 20 (C2/3) | VQR-SpBE3 |
| | | | UAGGAUUCCCGAGUAGCAGA | 453 | (TGAC) | 20 (C8/9) | VQR-SpBE3 |
| | | | UUUUAGGAUUCCCGAGUAGC | 454 | (AGAT) | 20 (11/12) | VQR-SpBE3 |
| E283K | GAG | AAG | UCUCUGUCACCUGCAUAGCU | 455 | (TGG) | 20 (C4) | SpBE3 |
| | | | AAGAGUCUCUGUCACCUGCA | 456 | (TAG) | 20 (C9) | SpBE3 |
| | | | AGUCUCUGUCACCUGCAUAG | 457 | (CTTGGT) | 20 (C6) | KKH-SaBE3 |
| G286R/E | GGG | AGG or GAG | CCAAGAGUCUCUGUCACCUGCA | 458 | (TAG) | 22 (-1/-2) | SpBE3 |
| C290Y | TGC | TAC | GCAGCAGUGCGUCAUCCCAA | 459 | (GAG) | 20 (C5) | SpBE3 |
| | | | UGCAGCAGUGCGUCAUCCCA | 460 | (AGAG) | 20 (C6) | VQR-SpBE3 |
| | | | AUGCAGCAGUGCGUCAUCCC | 461 | (AAG) | 20 (C7) | SpBE3 |
| | | | AUGCAGCAGUGCGUCAUCCC | 462 | (AAGAGT) | 20 (C7) | SaBE3 |
| C291Y | TGC | TAC | GCAGCAGUGCGUCAUCCCAA | 463 | (GAG) | 20 (C2) | VQR-SpBE3 |
| | | | AUGCAGCAGUGCGUCAUCCC | 464 | (AAG) | 20 (C4) | SpBE3 |
| | | | AUGCAGCAGUGCGUCAUCCC | 465 | (AAGAGT) | 20 (C4) | SaBE3 |
| P293S/L | CCC | TCC or CTC | CCCAUCAUCUAUGCCUUUGU | 466 | (CGG) | 20 (C1/2) | SpBE3 |
| | | | CCAUCAUCUAUGCCUUUGU | 467 | (CGG) | 19 (C2) | SpBE3 |
| P332S/L | CCC | TCC or CTC | GGCUCCCGAGCGAGCAAGCU | 468 | (CAG) | 20 (C4/5) | SpBE3 |
| | | | CAAGAGGCUCCCGAGCGAGC | 469 | (AAG) | 20 (10/11) | SpBE3 |
| | | | GAGGCUCCCGAGCGAGCAAG | 470 | (CTCAGT) | 20 (C7/8) | KKH-SaBE3 |

Base editors:
SpBE3 = APOBEC1-SpCas9n-UGI;
VQR-SpBE3 = APOBEC1-VQR-SpCas9n-UGI;
EQR-SpBE3 = APOBEC1-EQR-SpCas9n-UGI;
VRER-SpBE3 = APOBEC1-VRER-SpCas9n-UGI;
SaBE3 = APOBEC1-SaCas9n-UGI;
KKH-SaBE3 = APOBEC1-KKH-SaCas9n-UGI.

TABLE 5

Guide-RNAs designed for engineering new HIV-protective variants of genome/base editing of CCR5 using base-editor BE3.

| Target variant | Target codon | Stop codon | Designed guide-RNAs | SEQ ID NO: | (PAM) | Size (C#) | GE / BE method |
|---|---|---|---|---|---|---|---|
| Q4X | CAA | TAA (Ochre) | CAAGUGUCAAGUCCAAUCUA | 471 | (UGAC) | 20 (C1) | VQR-SpBE3 |
| | | | AAGAUGGAUUAUCAAGUGUC | 472 | (AAG) | 20 (C13) | SpBE3 |
| Q21X | CAA | TAA (Ochre) | CCUGCCAAAAAAUCAAUGUG | 473 | (AAG) | 20 (C6) | SpBE3 |
| | | | UGCCAAAAAAUCAAUGUGAA | 474 | (GCAAAT) | 20 (C4) | SaBE3 |
| W86X | TGG | TAG (Amber) or TGA (Opal) | CCCAGAAGGGGACAGUAAGA | 475 | (AGG) | 20 (C3/2) | SpBE3 |
| | | | GCCCAGAAGGGGACAGUAAG | 476 | (AAG) | 20 (C4/3) | SpBE3 |
| | | | GAGCCCAGAAGGGGACAGUA | 477 | (AGAA) | 20 (C5/4) | VQR-SpBE3 |
| | | | UGAGCCCAGAAGGGGACAGU | 478 | (AAG) | 20 (C6/7) | SpBE3 |
| | | | AGCAUAGUGAGCCCAGAAGGG | 479 | (GACAGT) | 21 (C13) | KKH-SaBE3 |

TABLE 5-continued

Guide-RNAs designed for engineering new HIV-protective variants of genome/base editing of CCR5 using base-editor BE3.

| Target variant | Target codon | Stop codon | Designed guide-RNAs | SEQ ID NO: | (PAM) | Size (C#) | GE / BE method |
|---|---|---|---|---|---|---|---|
| Q93X | CAG | TAG (Amber) | GCUGCCGCCCAGUGGGACUU | 480 | (TGG) | 20 (C9) | SpBE3 |
| | | | CUGCCGCCCAGUGGGACUUU | 481 | (GGAA) | 20 (C9) | VQR-SpBE3 |
| | | | CUGCCGCCCAGUGGGACUUU | 482 | (GGAAAT) | 20 (C9) | KKH-SaBE3 |
| | | | GCCCAGUGGGACUUUGGAAA | 483 | (TACAAT) | 20 (C4) | KKH-SaBE3 |
| W94X | TGG | TAG (Amber) or TGA (Opal) | AGUCCCACUGGGCGGCAGCA | 484 | (TAG) | 20 (C5/6) | SpBE3 |
| | | | UCCAAAGUCCCACUGGGCGG | 485 | (CAG) | 20 (C10) | SpBE3 |
| | | | CCCACUGGGCGGCAGCAUAG | 486 | (TGAG) | 20 (C2/1) | VQR-SpBE3 |
| | | | GUCCCACUGGGCGGCAGCAU | 487 | (AGTG) | 20 (C4/3) | VQR-SpBE3 |
| | | | CAAAGUCCCACUGGGCGGCAG | 488 | (CATAGT) | 21 (C8/9) | KKH-SaBE3 |
| Q102X | CAA | TAA (Ochre) | CAAUGUGUCAACUCUUGACA | 489 | (GGG) | 20 (C9) | SpBE3 |
| | | | ACAAUGUGUCAACUCUUGAC | 490 | (AGG) | 20 (C10) | SpBE3 |
| Q170X | CAA | TAA (Ochre) | UUUACCAGAUCUCAAAAAGA | 491 | (AGG) | 20 (C13) | SpBE3 |
| Q186X | CAG | TAG (Amber) | ACAGUCAGUAUCAAUUCUGG | 492 | (AAG) | 20 (C6) | SpBE3 |
| | | | CAUACAGUCAGUAUCAAUUC | 493 | (TGG) | 20 (C9) | SpBE3 |
| | | | AUACAGUCAGUAUCAAUUCU | 494 | (GGAA) | 20 (C8) | VQR-SpBE3 |
| | | | CAGUCAGUAUCAAUUCUGGA | 495 | (AGAA) | 20 (C5) | VQR-SpBE3 |
| | | | ACAGUCAGUAUCAAUUCUGG | 496 | (AAGAAT) | 20 (C6) | SaBE3 |
| Q188X | CAA | TAA (Ochre) | AUCAAUUCUGGAAGAAUUUC | 497 | (CAG) | 20 (C3) | SpBE3 |
| | | | ACAGUCAGUAUCAAUUCUGG | 498 | (AAG) | 20 (C12) | SpBE3 |
| | | | CAGUCAGUAUCAAUUCUGGA | 499 | (AGAA) | 20 (C11) | VQR-SpBE3 |
| | | | UCAAUUCUGGAAGAAUUUCC | 500 | (AGAC) | 20 (C2) | VQR-SpBE3 |
| | | | ACAGUCAGUAUCAAUUCUGG | 501 | (AAGAAT) | 20 (C12) | SaBE3 |
| W190X | TGG | TAG (Amber) or TGA (Opal) | CAGAAUUGAUACUGACUGUA | 502 | (TGG) | 20 (C1) | SpBE3 |
| | | | AAUUCUUCCAGAAUUGAUAC | 503 | (TGA) | 20 (C8/9) | SpBE3 |
| Q194X | CAG | TAG (Amber) | GAAUUUCCAGACAUUAAAGA | 504 | (TAG) | 20 (C8) | SpBE3 |
| | | | GGAAGAAUUUCCAGACAUUA | 505 | (AAG) | 20 (C12) | SpBE3 |
| | | | GAAGAAUUUCCAGACAUUAA | 506 | (AGAT) | 20 (C11) | VQR-SpBE3 |
| | | | UGGAAGAAUUUCCAGACAUU | 507 | (AAAGAT) | 20 (C13) | KKH-SaBE3 |
| | | | AAGAAUUUCCAGACAUUAAA | 508 | (GATAGT) | 20 (C10) | KKH-SaBE3 |
| W248X | TGG | TAG (Amber) or TGA (Opal) | CCAGAAGAGAAAAUAAACAAU | 509 | (CATGAT) | 21 (C1/-1) | KKH-SaBE3 |
| | | | GGAGCCCAGAAGAGAAAAUA | 510 | (AACAAT) | 20 (C7/6) | KKH-SaBE3 |
| Q261X | CAG | TAG (Amber) | AACACCUUCCAGGAAUUCUU | 511 | (TGG) | 20 (C10) | 20 (O10) |
| | | | CUUCCAGGAAUUCUUUGGCC | 512 | (TGAA) | 20 (C5) | 20(O5) |
| | | | CCUUCCAGGAAUUCUUUGGC | 513 | (CTGAAT) | 20 (C6) | 20(O6) |
| | | | UCCAGGAAUUCUUUGGCCUG | 514 | (AATAAT) | 20 (C3) | 20(O3) |
| Q277X | CAA | TAA (Ochre) | GGACCAAGCUAUGCAGGUGA | 515 | (CAG) | 20 (C5) | SpBE3 |
| | | | ACCAAGCUAUGCAGGUGACA | 516 | (GAG) | 20 (C3) | SpBE3 |
| | | | ACAGGUUGGACCAAGCUAUG | 517 | (CAG) | 20 (C12) | SpBE3 |
| | | | CAGGUUGGACCAAGCUAUGC | 518 | (AGG) | 20 (C11) | SpBE3 |
| | | | AGGUUGGACCAAGCUAUGCA | 519 | (GGTG) | 20 (C10) | VQR-SpBE3 |
| | | | GUUGGACCAAGCUAUGCAGG | 520 | (TGAC) | 20 (C8) | VQR-SpBE3 |
| | | | GACCAAGCUAUGCAGGUGAC | 521 | (AGAG) | 20 (C4) | VQR-SpBE3 |
| | | | AACAGGUUGGACCAAGCUAU | 522 | (GCAGGT) | 20 (C13) | KKH-SaBE3 |
| Q280X | CAG | TAG (Amber) | AUGCAGGUGACAGAGACUCU | 523 | (UGG) | 20 (C4) | SpBE3 |
| | | | UGCAGGUGACAGAGACUCUU | 524 | (GGG) | 20 (C3) | SpBE3 |
| | | | GACCAAGCUAUGCAGGUGAC | 525 | (AGAG) | 20 (C13) | VQR-SpBE3 |
| | | | ACCAAGCUAUGCAGGUGACA | 526 | (GAG) | 20 (C12) | SpBE3 |
| | | | CCAAGCUAUGCAGGUGACAG | 527 | (AGAC) | 20 (C11) | VQR-SpBE3 |
| | | | GCAGGUGACAGAGACUCUUG | 528 | (GGAU) | 20 (C2) | VQR-SpBE3 |
| | | | AUGCAGGUGACAGAGACUCU | 529 | (UGGGAU) | 20 (C4) | SaBE3 |

TABLE 5-continued

Guide-RNAs designed for engineering new HIV-protective variants of genome/base editing of CCR5 using base-editor BE3.

| Target variant | Target codon | Stop codon | Designed guide-RNAs | SEQ ID NO: | (PAM) | Size (C#) | GE / BE method |
|---|---|---|---|---|---|---|---|
| Q328X | CAG | TAG (Amber) | UUUUCCAGCAAGAGGCUCCC | 530 | (GAG) | 20 (C6) | VQR-SpBE3 |
| | | | AUUUUCCAGCAAGAGGCUCC | 531 | (CGAG) | 20 (C7) | EQR-SpBE3 |
| | | | UUUCCAGCAAGAGGCUCCCG | 532 | (AGCG) | 20 (C5) | VRER-SpBE3 |
| | | | UCCAGCAAGAGGCUCCCGAG | 533 | (CGAG) | 20 (C3) | EQR-SpBE3 |
| | | | CCAGCAAGAGGCUCCCGAGC | 534 | (GAG) | 20 (C2) | EQR-SpBE3 |
| Q329X | CAA | TAA (Ochre) | | same as above for Q328X | | | |
| R334X | CGA | TGA (Opal) | GGCUCCCGAGCGAGCAAGCU | 535 | (CAG) | 20 (C13) | SpBE3 |
| | | | GAGGCUCCCGAGCGAGCAAG | 536 | (CUCAGU) | 20 (C13) | KKH-SaBE3 |
| | | | GCGAGCAAGCUCAGUUUACA | 537 | (CCCGAU) | 20 (C2) | KKH-SaBE3 |
| R341X | CGA | TGA (Opal) | GUUUACACCCGAUCCACUGG | 538 | (GGAG) | 20 (C10) | VQR-SpBE3 |
| | | | ACACCCGAUCCACUGGGGAG | 539 | (CAG) | 20 (C6) | SpBE3 |
| | | | CACCCGAUCCACUGGGGAGC | 540 | (AGG) | 20 (C5) | SpBE3 |
| | | | ACCCGAUCCACUGGGGAGCA | 541 | (GGAA) | 20 (C4) | VQR-SpBE3 |
| | | | ACCCGAUCCACUGGGGAGCA | 542 | (GGAAAU) | 20 (C4) | KKH-SaBE3 |
| Q346X | CAA | TAA (Ochre) | GGGGAGCAGGAAAUAUCUGU | 543 | (GGG) | 20 (C7) | SpBE3 |
| | | | UGGGGAGCAGGAAAUAUCUG | 544 | (UGG) | 20 (C8) | SpBE3 |
| | | | ACUGGGGAGCAGGAAAUAUC | 545 | (UGUG) | 20 (C10) | VQR-SpBE3 |
| | | | GCAGGAAAUAUCUGUGGGCU | 546 | (UGUG) | 20 (C2) | VQR-SpBE3 |

Base editors:
SpBE3 = APOBEC1-SpCas9n-UGI;
VQR-SpBE3 = APOBEC1-VQR-SpCas9n-UGI;
EQR-SpBE3 = APOBEC1-EQR-SpCas9n-UGI;
VRER-SpBE3 = APOBEC1-VRER-SpCas9n-UGI;
SaBE3 = APOBEC1-SaCas9n-UGI;
KKH-SaBE3 = APOBEC1-KKH-SaCas9n-UGI.

TABLE 6

Examples of genome-editing reactions to introduce STOP codons to destabilize or prevent the translation of full-length functional CCR5 protein (FIG. 3), mimicking the HIV protective effect of the CCR5-Δ32 allele.

| Target codon | Amino acid (abbreviation) | Method | Genome-editing reaction(s) | Edited outcome | Stop codon name |
|---|---|---|---|---|---|
| CAG | Glutamine (Gln/Q) | Base-editing | $1^{st}$ base C → T coding strand | TAG | Amber |
| TGG | Tryptophan (Trp/W) | Base-editing | $2^{nd}$ base C → T on complementary strand | TAG | Amber |
| CGA | Arginine (Arg/R) | Base-editing | $1^{st}$ base C → T coding strand | TGA | Opal |
| CAA | Glutamine (Gln/Q) | Base-editing | $1^{st}$ base C → T coding strand | TAA | Ochre |
| TGG | Tryptophan (Trp/W) | Base-editing | $3^{rd}$ base C → T on complementary strand | UGA | Opal |
| CGG | Arginine (Arg/R) | Base-editing | $1^{st}$ base C → T on coding strand and $2^{nd}$ base C → T on complementary strand | TAG | Amber |
| CGA | Arginine (Arg/R) | Base-editing | $1^{st}$ base C → T on coding strand and $2^{nd}$ base C → T on complementary strand | TAA | Ochre |

TABLE 7

Examples of base-editing reactions to alter amino acid codons in order to produce novel CCR5 variants (FIG. 3).

| Target codon | Amino acid (abbreviations) | Base-editing reaction(s) | Edited codon | Edited amino acid (abbreviations) |
|---|---|---|---|---|
| CTT | Leucine (Leu/L) | $1^{st}$ base C → T on coding strand | TTT | Phenylalanine (Phe, F) |
| CTC | Leucine (Leu/L) | $1^{st}$ base C → T on coding strand | TTC | Phenylalanine (Phe, F) |
| ATG | Methionine (Met/M) | $3^{rd}$ base C → T on complementary strand | ATA | Isoleucine (Ile, I) |
| GTT | Valine (Val/V) | $1^{st}$ base C → T on complementary strand | ATT | Isoleucine (Ile, I) |
| GTC | Valine (Val/V) | $1^{st}$ base C → T on complementary strand | ATC | Isoleucine (Ile, I) |
| GTA | Valine (Val/V) | $1^{st}$ base C → T on complementary strand | ATA | Isoleucine (Ile, I) |
| GTG | Valine (Val/V) | $1^{st}$ base C → T on complementary strand | ATG | Methionine (Met/M) |
| TCT | Serine (Ser/S) | $2^{nd}$ base C → T on coding strand | TTT | Phenylalanine (Phe, F) |
| TCC | Serine (Ser/S) | $2^{nd}$ base C → T on coding strand | TTC | Phenylalanine (Phe, F) |
| TCA | Serine (Ser/S) | $2^{nd}$ base C → T on coding strand | TTA | Leucine (Leu/L) |
| TCG | Serine (Ser/S) | $2^{nd}$ base C → T on coding strand | TTG | Leucine (Leu/L) |
| AGT | Serine (Ser/S) | $2^{nd}$ base C → T on complementary strand | AAT | Asparagine (Asp/N) |
| AGC | Serine (Ser/S) | $2^{nd}$ base C → T on complementary strand | AAC | Asparagine (Asp/N) |
| CCT | Proline (Pro/P) | $1^{st}$ base C → T on coding strand | TCT | Serine (Ser/S) |
| CCC | Proline (Pro/P) | $1^{st}$ base C → T on coding strand | TCC | Serine (Ser/S) |
| CCA | Proline (Pro/P) | $1^{st}$ base C → T on coding strand | TCA | Serine (Ser/S) |
| CCG | Proline (Pro/P) | $1^{st}$ base C → T on coding strand | TCG | Serine (Ser/S) |
| CCT | Proline (Pro/P) | $2^{nd}$ base C → T on coding strand | CTT | Leucine (Leu/L) |
| CCC | Proline (Pro/P) | $2^{nd}$ base C → T on coding strand | CTC | Leucine (Leu/L) |
| CCA | Proline (Pro/P) | $2^{nd}$ base C → T on coding strand | CTA | Leucine (Leu/L) |
| CCG | Proline (Pro/P) | $2^{nd}$ base C → T on coding strand | CTG | Leucine (Leu/L) |
| ACT | Threonine (Thr/T) | $2^{nd}$ base C → T on coding strand | ATT | Isoleucine (Ile/I) |
| ACC | Threonine (Thr/T) | $2^{nd}$ base C → T on coding strand | ATC | Isoleucine (Ile/I) |
| ACA | Threonine (Thr/T) | $2^{nd}$ base C → T on coding strand | ATA | Isoleucine (Ile/I) |
| ACG | Threonine (Thr/T) | $2^{nd}$ base C → T on coding strand | ATG | Methionine (Met/M) |

TABLE 7-continued

Examples of base-editing reactions to alter amino acid codons in order to produce novel CCR5 variants (FIG. 3).

| Target codon | Amino acid (abbreviations) | Base

TABLE 7-continued

Examples of base-editing reactions to alter amino acid codons in order to produce novel CCR5 variants (FIG. 3).

| Target codon | Amino acid (abbreviations) | Base-editing reaction(s) | Edited codon | Edited amino acid (abbreviations) |
|---|---|---|---|---|
| GGG | Glycine (Gly/G) | $2^{nd}$ base C → T on complementary strand | GAG | Glutamate (Glu/E) |
| GGT | Glycine (Gly/G) | $1^{st}$ base C → T on complementary strand | AGT | Serine (Ser/S) |
| GGC | Glycine (Gly/G) | $1^{st}$ base C → T on complementary strand | AGC | Serine (Ser/S) |
| GGA | Glycine (Gly/G) | $1^{st}$ base C → T on complementary strand | AGA | Arginine (Arg/R) |
| GGG | Glycine (Gly/G) | $1^{st}$ base C → T on complementary strand | AGG | Arginine (Arg/R) |

TABLE 8

Examples of specific guide RNA sequences used for making variants. The sequences, from top to bottom, correspond to SEQ ID NOs: 547-636.

| CCR5 variant | Cas9-Be[a] | guide RNA sequence | PAM | C target | EfE[b] | Hsu[c] | Fusi |
|---|---|---|---|---|---|---|---|
| P332S/L | KKH-SaBE3 | GAGGCUCCCGAGCGAGCAAG | (CTCAGT) | C7/C8 | 4.9 | 97 | — |
| R334X | KKH-SaBE3 | GAGGCUCCCGAGCGAGCAAG | (CTCAGT) | C13 | 4.9 | 97 | — |
| W94X | SpBE3 | UCCAAAGUCCCACUGGGCGG | (CAG) | C10/C11 | 7.8 | 82 | 51 |
| C290Y, C291Y | SpBE3 | GCAGCAGUGCGUCAUCCCAA | (GAG) | C4/C-1 | 7.2 | 46 | 64 |
| P19S/L | VQR-SpBE3 | GAGCCCUGCCAAAAAAUCAA | (TGTG) | C5/C6 | 6.2 | 100 | — |
| W94X | KKH-SaBE3 | CAAAGUCCCACUGGGCGGCAG | (CATAGT) | C8/C9 | 5.0 | 98 | — |
| Q328X, Q329X | VRER-SpBE3 | UUUCCAGCAAGAGGCUCCCG | (AGCG) | C5/C8 | 5.5 | 95 | — |
| Q188X | SaBE3 | ACAGUCAGUAUCAAUUCUGG | (AAGAAT) | C12 | 4.5 | 92 | — |
| G115R/E | KKH-SaBE3 | GAUUCCAGAGAAGAAGCCUA | (TAAAAT) | C4/C5 | 5.4 | 87 | — |
| P19S/L | KKH-SaBE3 | UAUACAUCGGAGCCCUGCCA | (AAAAAT) | C13 | 4.8 | 97 | — |
| A335V | VQR-SpBE3 | GAGCAAGCUCAGUUUACACC | (CGAT) | C4 | 7.8 | 82 | — |
| R341X | VQR-SpBE3 | GUUUACACCCGAUCCACUGG | (GGAG) | C10 | 6.8 | 91 | — |
| Q277X | VQR-SpBE3 | AGGUUGGACCAAGCUAUGCA | (GGTG) | C10 | 7.6 | 99 | — |
| E283K | KKH-SaBE3 | AGUCUCUGUCACCUGCAUAG | (CTTGGT) | C6 | 9.0 | 91 | — |
| G44D/S | SaBE3 | AAAACCAAAGAUGAACACCA | (GTGAGT) | C5/C6 | 4.6 | 44 | — |
| G163R/E | VQR-SpBE3 | GUAAAGAUGAUUCCUGGGAG | (AGAC) | C13 | 4.9 | 41 | — |
| Q186X | SpBE3 | ACAGUCAGUAUCAAUUCUGG | (AAG) | C6 | 4.5 | 62 | 66 |
| W248X | KKH-SaBE3 | GGAGCCCAGAAGAGAAAAUA | (AACAAT) | C7/6 | 5.2 | 82 | — |
| G47S/D | VQR-SpBE3 | CAUGUUGCCCACAAAACCAA | (AGAT) | C8/C9 | 7.1 | 39 | — |
| Q277X | SpBE3 | ACAGGUUGGACCAAGCUAUG | (CAG) | C12 | 5.5 | 81 | 68 |
| Q277X | KKH-SaBE3 | AACAGGUUGGACCAAGCUAU | (GCAGGT) | C13 | 5.6 | 95 | — |
| P183S/L | KKH-SaBE3 | UCAUUUUCCAUACAGUCAGU | (ATCAAT) | C8 | 3.7 | 89 | — |
| G202R/E | KKH-SaBE3 | UCAUUUUCCAUACAGUCAGU | (ATCAAT) | C6/C7 | 3.7 | 89 | — |

TABLE 8-continued

Examples of specific guide RNA sequences used for making variants. The sequences, from top to bottom, correspond to SEQ ID NOs: 547-636.

| | | | | | | | |
|---|---|---|---|---|---|---|---|
| R334X | KKH-SaBE3 | GCGAGCAAGCUCAGUUUACA | (CCCGAT) | C2 | 7.2 | 95 | — |
| S149N | KKH-SaBE3 | AUCACACUUGUCACCACCCC | (AAAGGT) | C7 | 4.7 | 90 | — |
| C20Y | KKH-SaBE3 | UUGGCAGGGCUCCGAUGUAU | (AATAAT) | C5 | 7.5 | 99 | — |
| Q4X | VQR-SpBE3 | CAAGUGUCAAGUCCAAUCUA | (TGAC) | C1 | 3.5 | 81 | — |
| C178Y | SpBE3 | UGAGAGCUGCAGGUGUAAUG | (AAG) | C10 | 10.1 | 70 | 58 |
| P332S/L | SpBE3 | CAAGAGGCUCCCGAGCGAGC | (AAG) | C10/C11 | 6.8 | 87 | 47 |
| Q93X | KKH-SaBE3 | GCCCAGUGGGACUUUGGAAA | (TACAAT) | C4 | 6.0 | 92 | — |
| C20Y | KKH-SaBE3 | CAGGGCUCCGAUGUAUAAUA | (ATTGAT) | C1 | 6.9 | 96 | — |
| D2N | VRER-SpBE3 | UAAUCCAUCUUGUUCCACCC | (TGTG) | C5 | 5.6 | 99 | — |
| P332S/L | SpBE3 | GGCUCCCGAGCGAGCAAGCU | (CAG) | C5/C6 | 4.2 | 88 | 43 |
| R334X | SpBE3 | GGCUCCCGAGCGAGCAAGCU | (CAG) | C13 | 4.2 | 88 | 43 |
| G216S/D | VQR-SpBE3 | UAGGAUUCCCGAGUAGCAGA | (TGAC) | C8/C9 | 7.7 | 45 | — |
| W86X | VQR-SpBE3 | GAGCCCAGAAGGGGACAGUA | (AGAA) | C5/C6 | 5.2 | 54 | — |
| C290Y, C291Y | SaBE3 | AUGCAGCAGUGCGUCAUCCC | (AAGAGT) | C4/C7 | 8.2 | 65 | — |
| S149N | VQR-SpBE3 | ACUUGUCACCACCCCAAAGG | (TGAC) | C2 | 7.4 | 40 | — |
| C269Y | VQR-SpBE3 | ACUGCAAUUAUUCAGGCCAA | (AGA) | C5 | 5.3 | 58 | — |
| D2N | KKH-SaBE3 | CCAUCUUGUUCCACCCUGUGC | (ATAAAT) | C-1 | 4.2 | 94 | — |
| C178Y | VQR-SpBE3 | GAGAGCUGCAGGUGUAAUGA | (AGA) | C9 | 3.2 | 70 | — |
| S149N | SpBE3 | CACACUUGUCACCACCCCAA | (AGG) | C5 | 6.2 | 39 | 64 |
| P19S/L | KKH-SaBE3 | CAUCGGAGCCCUGCCAAAAA | (ATCAAT) | C9/10 | 7.4 | 93 | — |
| Q261X | KKH-SaBE3 | UCCAGGAAUUCUUUGGCCUG | (AATAAT) | C3 | 6.5 | 88 | — |
| C290Y, C291Y | SpBE3 | AUGCAGCAGUGCGUCAUCCC | (AAG) | C4/C7 | 8.2 | 59 | 50 |
| Q93X | KKH-SaBE3 | CUGCCGCCCAGUGGGACUUU | (GGAAAT) | C9 | 6.2 | 96 | 40 |
| C269Y | SaBE3 | UACUGCAAUUAUUCAGGCCA | (AAGAAT) | C6 | 4.4 | 93 | — |
| P206S/L | KKH-SaBE3 | CUGGUCCUGCCCGCUGCUUGU | (CATGGT) | C10/C11 | 9.7 | 88 | — |
| G47S/D | VQR-SpBE3 | GUUGCCCACAAAACCAAAGA | (TGAA) | C5/C6 | 5.1 | 37 | — |
| G47S/D | KKH-SaBE3 | AGCAUGUUGCCCACAAAACC | (AAAGAT) | C10/C11 | 6.2 | 90 | — |
| Q93X | SpBE3 | GCUGCCGCCCAGUGGGACUU | (TGG) | C10 | 7.4 | 70 | 42 |
| R341X | KKH-SaBE3 | ACCCGAUCCACUGGGGAGCA | (GGAAAT) | C4 | 4.4 | 94 | 55 |
| P34S/L, P35S/L | SpBE3 | CCUGCCUCCGCUCUACUCAC | (TGG) | C5-C9 | 6.3 | 55 | 47 |
| G216S/D | VQR-SpBE3 | UCCCGAGUAGCAGAUGACCA | (TGAC) | C2/C3 | 3.9 | 46 | — |
| Splice site | VQR-SpBE3 | UGCACAGGGUGGAACAAGAU | (GGAT) | C5 | 5.5 | 65 | — |
| Splice site | SpBE3 | AUGCACAGGGUGGAACAAGA | (TGG) | C6 | 4.9 | 42 | 55 |
| Splice site | KKH-SaBE3 | UUCCACCCUGUGCAUAAAUA | (AAAAGT) | C7/8 | 3.1 | 93 | — |
| Splice site | VQR-SpBE3 | CCCUGUGCAUAAAUAAAAAG | (TGA) | C3/2 | 6.3 | 36 | — |

TABLE 8-continued

Examples of specific guide RNA sequences used for making variants. The sequences, from top to bottom, correspond to SEQ ID NOs: 547-636.

| | | | | | | | |
|---|---|---|---|---|---|---|---|
| Q277X | SpBE3 | CAGGUUGGACCAAGCUAUGC | (AGG) | C11 | 6.1 | 79 | 47 |
| Q93X | VQR-SpBE3 | CUGCCGCCCAGUGGGACUUU | (GGAA) | C9 | 6.2 | 78 | — |
| R223Q | SaBE3 | CGAAGCAGAGUUUUAGGAUUC | (CCGAGT) | C-2 | 6.5 | 86 | — |
| G44D/S | KKH-SaBE3 | CCACAAACCAAAGAUGAAC | (ACCAGT) | C9/C10 | 6.1 | 85 | — |
| P206S/L | SpBE3 | GGUCCUGCCGCUGCUUGUCA | (TGG) | C8/C9 | 4.9 | 65 | 46 |
| P34S/L, P35S/L | KKH-SaBE3 | CUCCUGCCUCCGCUCUACUC | (ACTGGT) | C3-C8 | 7.2 | 93 | — |
| W94X | VQR-SpBE3 | CCCACUGGGCGGcAGcAuAG | (TGAG) | C2/1 | 7.3 | 85 | — |
| Splice site | SpBE3 | AUUUAUGCACAGGGUGGAAC | (AAG) | C10 | 7.7 | 61 | 39 |
| Splice site | VQR-SpBE3 | UUUAUGCACAGGGUGGAACA | (AGAT) | C9 | 6.9 | 58 | — |
| C290Y, C291Y | VQR-SpBE3 | UGCAGCAGUGCGUCAUCCCA | (AGAG) | C6/C3 | 7.2 | 59 | — |
| W190X | SpBE3 | CAGAAUUGAUACUGACUGUA | (TGG) | C1 | 3.7 | 73 | 42 |
| Q102X | SpBE3 | ACAAUGUGUCAACUCUUGAC | (AGG) | C10 | 8.3 | 77 | 50 |
| Q21X | SaBE3 | UGCCAAAAAAUCAAUGUGAA | (GCAAAT) | C4 | 3.7 | 75 | — |
| Splice site | WT SpCas9 | GAGGGCAACUAAAUACAUUC | (TAG) | n/a | 6.5 | 69 | 40 |
| Q280X | SaBE3 | AUGCAGGUGACAGAGACUCU | (TGGGAT) | C4 | 6.4 | 47 | 49 |
| R341X | SpBE3 | CACCCGAUCCACUGGGGAGC | (AGG) | C5 | 6.9 | 68 | 45 |
| R223Q | VQR-SpBE3 | ACACCGAAGCAGAGUUUUA | (GGA) | C5 | 7.1 | 63 | — |
| P162S/L | KKH-SaBE3 | UCUCCCAGGAAUCAUCUUUA | (CCAGAT) | C5/C6 | 6.0 | 91 | — |
| Q261X | VQR-SpBE3 | CUUCCAGGAAUUCUUUGGCC | (TGAA) | C5 | 6.3 | 56 | — |
| Splice site | WT SpCas9 | AGGGCAACUAAAUACAUUCU | (AGG) | n/a | 5.3 | 40 | 40 |
| W190X | SpBE3 | AAUUCUUCCAGAAUUGAUAC | (TGA) | C8/9 | 5.6 | 61 | — |
| P162S/L | VQR-SpBE3 | UCCCAGGAAUCAUCUUUACC | (AGAT) | C3/C4 | 3.3 | 74 | — |
| Q328X, Q329X | EQR-SpBE3 | AUUUUCCAGCAAGAGGCUCC | (CGAG) | C7/C10 | 9.8 | 54 | — |
| Splice site | WT SpCas9 | AAACUGUUUUAUACAUCAAU | (AGG) | n/a | 4.4 | 49 | 36 |
| R223Q | SaBE3 | CGACACCGAAGCAGAGUUUU | (TAGGAT) | C7 | 4.7 | 77 | — |
| Q261X | SaBE3 | CCUUCCAGGAAUUCUUUGGC | (CTGAAT) | C6 | 6.1 | 61 | — |
| G145R/E | SpBE3 | CACCCCAAAGGUGACCGUCC | (TGG) | C5/C6 | 5.4 | 48 | 51 |
| R223Q | SpBE3 | CGACACCGAAGCAGAGUUUU | (TAG) | C7 | 4.7 | 68 | 14 |
| P293S/L | SpBE3 | CCCAUCAUCUAUGCCUUUGU | (CGG) | C1/C2 | 6.3 | 58 | 44 |
| R223Q | SpBE3 | GACACCGAAGCAGAGUUUUA | (AGG) | C6 | 5.3 | 70 | 22 |
| Q261X | SpBE3 | AACACCUUCCAGGAAUUCUU | (TGG) | C10 | 7.0 | 34 | 31 |
| P183S/L | SpBE3 | CAUACAGUCAGUAUCAAUUC | (TGG) | C1-/-1 | 7.1 | 41 | 27 |

TABLE 8-continued

Examples of specific guide RNA sequences used for making variants. The sequences, from top to bottom, correspond to SEQ ID NOs: 547-636.

| CCR5 variant | Chari | Doench | Wang | M.-M. | Housden | Prox/GC | Off-targets[d] |
|---|---|---|---|---|---|---|---|
| P332S/L | 85 | 38 | 80 | 92 | 4 | − | 0 - 0 - 0 - 1 - 8 |
| R334X | 85 | 38 | 80 | 92 | 4 | − | 0 - 0 - 0 - 1 - 8 |
| W94X | 91 | 69 | 85 | 57 | 7 | +GG | 0 - 0 - 0 - 12 -109 |
| C290Y, C291Y | 88 | 87 | 84 | 60 | 7 | − | 0 - 1 - 0 - 8 - 88 |
| P19S/L | 85 | 49 | 83 | 41 | 6 | − | 0 - 0 - 0 - 0 - 2 |
| W94X | 65 | 19 | 76 | 76 | 7 | + | 0 - 0 - 0 - 1 - 19 |
| Q328X, Q329X | 96 | 38 | 73 | 53 | 5 | + | 0 - 0 - 0 - 2 - 6 |
| Q188X | 84 | 39 | 87 | 36 | 4 | −GG | 0 - 0 - 0 - 2 - 31 |
| G115R/E | 95 | 44 | 78 | 45 | 5 | − | 0 - 0 - 0 - 4 - 46 |
| P19S/L | 36 | 30 | 78 | 48 | 4 | + | 0 - 0 - 0 - 1 - 9 |
| A335V | 10 | 53 | 70 | 39 | 7 | − | 0 - 0 - 0 - 8 - 88 |
| R341X | 87 | 30 | 83 | 37 | 6 | +GG | 0 - 0 - 0 - 2 - 31 |
| Q277X | 67 | 27 | 71 | 35 | 7 | − | 0 - 0 - 0 - 1 - 5 |
| E283K | 81 | 39 | 62 | 40 | 9 | − | 0 - 0 - 0 - 6 - 42 |
| G44D/S | 94 | 54 | 86 | 45 | 4 | − | 1 - 0 - 0 - 13 -190 |
| G163R/E | 70 | 51 | 84 | 50 | 4 | + | 0 - 1 - 2 - 37-211 |
| Q186X | 84 | 37 | 87 | 36 | 4 | −GG | 0 - 0 - 2 - 25 - 95 |
| W248X | 86 | 12 | 77 | 48 | 5 | − | 0 - 0 - 1 - 3 - 95 |
| G47S/D | 65 | 41 | 81 | 58 | 7 | − | 1 - 0 - 0 - 17 - 207 |
| Q277X | 95 | 21 | 47 | 69 | 5 | − | 0 - 0 - 0 - 11 - 78 |
| Q277X | 18 | 17 | 46 | 54 | 5 | − | 0 - 0 - 0 - 3 - 15 |
| P183S/L | 42 | 43 | 52 | 28 | 3 | − | 0 - 0 - 0 - 9 - 53 |
| G202R/E | 42 | 43 | 52 | 28 | 3 | − | 0 - 0 - 0 - 9 - 53 |
| R334X | 60 | 29 | 41 | 46 | 7 | − | 0 - 0 - 0 - 1 - 14 |
| S149N | 53 | 1 | 60 | 58 | 4 | + | 0 - 0 - 0 - 4 - 36 |

TABLE 8-continued

Examples of specific guide RNA sequences used for making variants. The sequences, from top to bottom, correspond to SEQ ID NOs: 547-636.

| | | | | | | | |
|---|---|---|---|---|---|---|---|
| C20Y | 8 | 2 | 36 | 71 | 7 | − | 0 - 0 - 0 - 1 - 6 |
| Q4X | 23 | 5 | 72 | 48 | 3 | − | 0 - 0 - 1 - 9 - 139 |
| C178Y | 85 | 31 | 66 | 38 | 10 | − | 0 - 0 - 0 - 26 - 226 |
| P332S/L | 60 | 3 | 77 | 35 | 6 | + | 0 - 0 - 0 - 4 - 100 |
| Q93X | 28 | 11 | 59 | 39 | 6 | − | 0 - 0 - 0 - 6 - 38 |
| C20Y | 9 | 8 | 41 | 55 | 6 | − | 0 - 0 - 0 - 1 - 15 |
| D2N | 35 | 12 | 57 | 30 | 5 | + | 0 - 0 - 0 - 0 - 3 |
| P332S/L | 68 | 9 | 47 | 50 | 4 | − | 0 - 0 - 0 - 4 - 61 |
| R334X | 68 | 9 | 47 | 50 | 4 | − | 0 - 0 - 0 - 4 - 61 |
| G216S/D | 48 | 27 | 76 | 46 | 7 | − | 0 - 1 - 0 - 5 - 99 |
| W86X | 93 | 8 | 63 | 68 | 4 | − | 0 - 0 - 2 - 29 - 348 |
| C290Y, C291Y | 65 | 8 | 57 | 62 | 8 | + | 0 - 1 - 0 - 2 - 26 |
| S149N | 95 | 23 | 78 | 51 | 7 | −GG | 1 - 0 - 0 - 10 - 148 |
| C269Y | 70 | 7 | 61 | 65 | 5 | + | 0 - 0 - 2 - 26 - 277 |
| D2N | 19 | 7 | 57 | 30 | 6 | + | 0 - 0 - 0 - 3 -29 |
| C178Y | 53 | 6 | 76 | 36 | 3 | − | 0 - 0 - 0 - 22 - 251 |
| S149N | 87 | 21 | 65 | 63 | 6 | + | 1 - 0 - 0 - 22 - 147 |
| P19S/L | 66 | 15 | 38 | 40 | 7 | − | 0 - 0 - 0 - 0 - 19 |
| Q261X | 79 | 8 | 41 | 49 | 6 | + | 0 - 0 - 0 - 3 - 59 |
| C290Y, C291Y | 65 | 7 | 57 | 62 | 8 | + | 0 - 1 - 1 - 5 - 83 |
| Q93X | 16 | 3 | 18 | 67 | 6 | − | 0 - 0 - 0 - 0 - 16 |
| C269Y | 15 | 11 | 57 | 22 | 4 | + | 0 - 0 - 0 - 4 - 38 |
| P206S/L | 22 | 6 | 29 | 60 | 9 | − | 0 - 0 - 1 - 3 - 48 |
| G47S/D | 94 | 24 | 88 | 32 | 5 | − | 1 - 1 - 1 - 15 - 198 |
| G47S/D | 27 | 13 | 56 | 21 | 6 | − | 0 - 0 - 0 - 6 - 36 |

TABLE 8-continued

Examples of specific guide RNA sequences used for making variants. The sequences, from top to bottom, correspond to SEQ ID NOs: 547-636.

| | | | | | | | |
|---|---|---|---|---|---|---|---|
| Q93X | 32 | 3 | 56 | 51 | 7 | − | 0 - 0 - 2 - 13 - 126 |
| R341X | 28 | 7 | 26 | 51 | 4 | + | 0 - 0 - 0 - 1 - 18 |
| P34S/L, P35S/L | 25 | 17 | 47 | 56 | 6 | − | 0 - 1 - 0 - 26 - 175 |
| G216S/D | 68 | 31 | 53 | 44 | 3 | − | 1 - 0 - 0 - 4 - 60 |
| Splice site | 47 | 8 | 29 | 71 | 5 | − | 0 - 0 - 1 - 15 - 253 |
| Splice site | 71 | 11 | 65 | 55 | 4 | − | 0 - 0 - 1 - 43 - 421 |
| Splice site | 31 | 11 | 24 | 43 | 3 | − | 0 - 0 - 0 - 5 - 26 |
| Splice site | 72 | 44 | 67 | 21 | 6 | − | 0 - 1 - 3 - 40 - 394 |
| Q277X | 44 | 4 | 50 | 33 | 6 | − | 0 - 0 - 2 - 9 - 77 |
| Q93X | 16 | 3 | 18 | 67 | 6 | − | 0 - 0 - 1 - 4 - 88 |
| R223Q | 4 | 2 | 19 | 57 | 4 | − | 0 - 0 - 1 - 9 - 74 |
| G44D/S | 39 | 9 | 54 | 16 | 6 | − | 0 - 0 - 1 - 6 - 77 |
| P206S/L | 14 | 4 | 62 | 33 | 4 | − | 0 - 0 - 3 - 18 - 149 |
| P34S/L, P35S/L | 12 | 3 | 29 | 37 | 7 | − | 0 - 0 - 0 - 6 - 47 |
| W94X | 94 | 1 | 42 | 31 | 7 | − | 0 - 0 - 0 - 7 - 98 |
| Splice site | 11 | 13 | 41 | 44 | 7 | − | 0 - 0 - 3 - 11 - 172 |
| Splice site | 82 | 9 | 45 | 46 | 6 | − | 0 - 0 - 2 - 18 - 283 |
| C290Y, C291Y | 51 | 7 | 40 | 51 | 3 | − | 0 - 1 - 0 - 7 - 73 |
| W190X | 41 | 3 | 32 | 48 | 3 | − | 0 - 0 - 1 - 14 - 140 |
| Q102X | 55 | 9 | 48 | 21 | 8 | − | 0 - 0 - 1 - 7 - 96 |
| Q21X | 48 | 22 | 24 | 30 | 3 | − | 0 - 0 - 0 - 18 - 172 |
| Splice site | 51 | 2 | 69 | 10 | 6 | − | 0 - 0 - 0 - 15 - 134 |
| Q280X | 48 | 3 | 54 | 43 | 6 | − | 0 - 1 - 0 - 6 - 55 |
| R341X | 32 | 1 | 42 | 34 | 6 | + | 0 - 0 - 1 - 17 - 100 |
| R223Q | 47 | 21 | 30 | 30 | 7 | − | 0 - 0 - 3 - 10 - 160 |
| P162S/L | 56 | 1 | 23 | 24 | 6 | − | 0 - 0 - 0 - 1 - 50 |

TABLE 8-continued

Examples of specific guide RNA sequences used for making variants. The sequences, from top to bottom, correspond to SEQ ID NOs: 547-636.

| | | | | | | | |
|---|---|---|---|---|---|---|---|
| Q261X | 10 | 7 | 49 | 27 | 6 | + | 0 - 1 - 2 - 20 - 207 |
| Splice site | 14 | 2 | 56 | 40 | 5 | − | 0 - 0 - 6 - 39 - 217 |
| W190X | 14 | 12 | 49 | 11 | 5 | − | 0 - 0 - 0 - 34 - 335 |
| P162S/L | 35 | 10 | 21 | 25 | 3 | − | 0 - 0 - 2 - 16 - 168 |
| Q328X, Q329X | 56 | 5 | 39 | 32 | 9 | + | 0 - 0 - 3 - 18 - 484 |
| Splice site | 5 | 6 | 48 | 25 | 4 | − | 0 - 0 - 7 - 33 - 312 |
| R223Q | 21 | 3 | 14 | 33 | 4 | − | 0 - 1 - 0 - 0 - 11 |
| Q261X | 16 | 10 | 38 | 14 | 6 | − | 0 - 1 - 2 - 2 - 54 |
| G145R/E | 32 | 0 | 29 | 44 | 5 | + | 0 - 1 - 0 - 3 - 71 |
| R223Q | 21 | 2 | 14 | 33 | 4 | − | 0 - 1 - 0 - 4 - 43 |
| P293S/L | 2 | 5 | 18 | 35 | 6 | − | 0 - 1 - 2 - 23 - 127 |
| R223Q | 76 | 3 | 17 | 25 | 5 | − | 0 - 0 - 4 - 10 - 92 |
| Q261X | 15 | 13 | 41 | 21 | 7 | − | 1 - 0 - 3 - 29 - 202 |
| P183S/L | 15 | 5 | 36 | 25 | 7 | − | 0 - 1 - 2 - 17 - 133 |

[a] Base editors: SpBE3 = APOBEC1-SpCas9n-UGI; VQR-SpBE3 = APOBEC1-VQR-SpCas9n-UGI; EQR-SpBE3 = APOBEC1-EQR-SpCas9n-UGI; VRER-SpBE3 = APOBEC1-VRER-SpCas9n-UGI; SaBE3 = APOBEC1-SaCas9n-UGI; KKH-SaBE3 = APOBEC1-KKH-SaCas9n-UGI.
[b] Efficiency score, based on Housden et al (Science Signaling, 2015, 8(393): rs9), which is herein incorporated by reference in its entirety.
[c] Specificity scores based on Hsu et al (Nature biotechnology, 2013, 31(9): 827-832), Fusi et al (bioRxiv 021568; doi: http://dx.doi.org/10.1101/021568), Chari et al (Nature Methods, 2015, 12(9): 823-6), Doench et al (Nature Biotechnology, 2014, 32(12): 1262-7), Wang et al (Science, 2014, 343(6166): 80-4), Moreno-Mateos et al (Nature Methods, 2015, 12(10): 982-8), Housden et al (Science Signaling, 2015, 8(393): rs9), and the "Prox/GC" column shows "+" if the proximal 6 bp to the PAM has a GC count ≥4, and GG if the guide ends with GG, based on Farboud et al (Genetics, 2015, 199(4): 959-71). Each of the foregoing references is hereby incorporated by reference in its entirety.
[d] Number of predicted off-target binding sites in the human genome allowing up to 0, 1, 2, 3 or 4 mismatches, respectively shown in the format 0 - 1 - 2 - 3 - 4. Algorithm used: Haeussler et al, Genome Biol. 2016; 17: 148, which is herein incorporated by reference in its entirety.

TABLE 9

Examples of specific guide RNA sequences used for making variants. The guide RNA sequences, from top to bottom, correspond to SEQ ID NOs: 637-657 and the CCR2 sequences, from top to bottom, correspond to SEQ ID NOs: 658-678.

| CCR5 variant | Cas9-BE | guide RNA sequence | PAM | C target | CCR2 seq. (gRNA mismatches) | (m) | Eff.[a] | Hsub |
|---|---|---|---|---|---|---|---|---|
| C290Y/ C291Y | SpBE3 | GCAGCAGUGCGUCAUCCCAA | (GAG) | C5 | GCAGCAGTGAGTCATCCCAAGAG | 1 | 7.2 | 46 |
| G44D/S | SaBE3 | AAAACCAAAGAUGAACACCA | (GTGAGT) | C5/C6 | AAAACCAAAGATGAACACCAGCGAGT | 0 | 4.6 | 44 |
| G163R/E | VQR-SpBE3 | GUAAAGAUGAUUCCUGGGAG | (AGAC) | C13 | GTAAAGATGATTCCTGGGACAGAC | 1 | 4.9 | 41 |
| G47S/D | VQR-SpBE3 | CAUGUUGCCCACAAAACCAA | (AGAT) | C8/C9 | CATGTTGCCCACAAAACCAAAGAT | 0 | 7.1 | 39 |

TABLE 9-continued

Examples of specific guide RNA sequences used for making variants. The guide RNA sequences, from top to bottom, correspond to SEQ ID NOs: 637-657 and the CCR2 sequences, from top to bottom, correspond to SEQ ID NOs: 658-678.

| Variant | BE | Guide RNA | PAM | Target C | CCR2 sequence | Mismatches | Score1 | Score2 |
|---|---|---|---|---|---|---|---|---|
| G216S/D | VQR-SpBE3 | UAGGAUUCCCGAGUAGCAGA | (TGAC) | C8/C9 | CAGGATTCCCGAGTAGCAGATGAC | 1 | 7.7 | 45 |
| C290Y/C291Y | SaBE3 | AUGCAGCAGUGCGUCAUCCC | (AAGAGT) | C4/C7 | ATGCAGCAGTGAGTCATCCCAAGAGT | 1 | 8.2 | 65 |
| S149N | VQR-SpBE3 | ACUUGUCACCACCCCAAAGG | (TGAC) | C2 | ACTTGTCACCACCCCAAAGGTGAC | 0 | 7.4 | 40 |
| S149N | SpBE3 | CACACUUGUCACCACCCCAA | (AGG) | C5 | CACACTTGTCACCACCCCAAAGG | 0 | 6.2 | 39 |
| C290Y/C291Y | SpBE3 | AUGCAGCAGUGCGUCAUCCC | (AAG) | C4/C7 | ATGCAGCAGTGAGTCATCCCAAG | 1 | 8.2 | 59 |
| G47S/D | VQR-SpBE3 | GUUGCCCACAAAACCAAAGA | (TGAA) | C5/C6 | GTTGCCCACAAAACCAAAGATGAA | 0 | 5.1 | 37 |
| P34S/L/P35S/L | SpBE3 | CCUGCCUCCGCUCUACUCAC | (TGG) | C5-C9 | CCTGCCTCCGCTCTACTCGCTGG | 1 | 6.3 | 55 |
| G216S/D | VQR-SpBE3 | UCCCGAGUAGCAGAUGACCA | (TGAC) | C2/C3 | TCCCGAGTAGCAGATGACCATGAC | 0 | 3.9 | 46 |
| C290Y/C291Y | VQR-SpBE3 | UGCAGCAGUGCGUCAUCCCA | (AGAG) | C6 | TGCAGCAGTGAGTCATCCCAAGAG | 1 | 7.2 | 59 |
| Q280X | SaBE3 | AUGCAGGUGACAGAGACUCU | (TGGGAT) | C4 | ACGCAGGTGACAGAGACTCTTGGGAT | 1 | 6.4 | 47 |
| Q261X | VQR-SpBE3 | CUUCCAGGAAUUCUUUGGCC | (TGAA) | C5 | CTTCCAGGAATTCTTCGGCCTGAA | 1 | 6.3 | 56 |
| R223Q | SaBE3 | CGACACCGAAGCAGAGUUUU | (TAGGAT) | C7 | CGACACCGAAGCAGCGTTTTCAGGAT | 1 | 4.7 | 77 |
| Q261X | SaBE3 | CCUUCCAGGAAUUCUUUGGC | (CTGAAT) | C6 | CCTTCCAGGAATTCTTCGGCCTGAGT | 1 | 6.1 | 61 |
| G145R/E | SpBE3 | CACCCCAAAGGUGACCGUCC | (TGG) | C5/C6 | CACCCCAAAGGTGACCGTCCTGG | 0 | 5.4 | 48 |
| R223Q | SpBE3 | CGACACCGAAGCAGAGUUUU | (TAG) | C7 | CGACACCGAAGCAGGGTTTTCAG | 1 | 4.7 | 68 |
| P293S/L | SpBE3 | CCCAUCAUCUAUGCCUUUGU | (CGG) | C1/C2 | CCCATCATCTATGCCTTCGTTGG | 1 | 6.3 | 58 |
| Q261X | SpBE3 | AACACCUUCCAGGAAUUCUU | (TGG) | C10 | AACACCTTCCAGGAATTCTTCGG | 0 | 7.0 | 34 |

| CCR5 variant | Doench[h] | M.-M. | Off-targets[c] (corrected) |
|---|---|---|---|
| C290Y/C291Y | 87 | 60 | 0 - 0 - 0 - 8 - 88 |
| G44D/S | 54 | 45 | 0 - 0 - 0 - 13 - 190 |
| G163R/E | 51 | 50 | 0 - 0 - 2 - 37 - 211 |
| G47S/D | 41 | 58 | 0 - 0 - 0 - 17 - 207 |
| G216S/D | 27 | 46 | 0 - 0 - 0 - 5 - 99 |
| C290Y/C291Y | 8 | 62 | 0 - 0 - 0 - 2 - 26 |
| S149N | 23 | 51 | 0 - 0 - 0 - 10 - 148 |
| S149N | 21 | 63 | 0 - 0 - 0 - 22 - 147 |
| C290Y/C291Y | 7 | 62 | 0 - 0 - 1 - 5 - 83 |

TABLE 9-continued

Examples of specific guide RNA sequences used for making variants. The guide RNA sequences, from top to bottom, correspond to SEQ ID NOs: 637-657 and the CCR2 sequences, from top to bottom, correspond to SEQ ID NOs: 658-678.

| | | | |
|---|---|---|---|
| G47S/D | 24 | 32 | 0 - 1 - 1 - 15 - 198 |
| P34S/L/ P35S/L | 17 | 56 | 0 - 0 - 0 - 26 - 175 |
| G216S/ D | 31 | 44 | 0 - 0 - 0 - 4 - 60 |
| C290Y/ C291Y | 7 | 51 | 0 - 0 - 0 - 7 - 73 |
| Q280X | 3 | 43 | 0 - 0 - 0 - 6 - 55 |
| Q261X | 7 | 27 | 0 - 0 - 2 - 20 - 207 |
| R223Q | 3 | 33 | 0 - 0 - 0 - 0 - 11 |
| Q261X | 10 | 14 | 0 - 0 - 2 - 2 - 54 |
| G145R/ E | 0 | 44 | 0 - 0 - 0 - 3 - 71 |
| R223Q | 2 | 33 | 0 - 0 - 0 - 4 - 43 |
| P293S/ L | 5 | 35 | 0 - 0 - 2 - 23 - 127 |
| Q261X | 13 | 21 | 0 - 0 - 3 - 29 - 202 |

[a] Base editors: SpBE3 = APOBEC1-SpCas9n-UGI; VQR-SpBE3 = APOBEC1-VQR-SpCas9n-UGI; EQR-SpBE3 = APOBEC1-EQR-SpCas9n-UGI; VRER-SpBE3 = APOBEC1-VRER-SpCas9n-UGI; SaBE3 = APOBEC1-SaCas9n-UGI; KKH-SaBE3 = APOBEC1-KKH-SaCas9n-UGI.
[b] Efficiency score, based on Housden et al (Science Signaling, 2015, 8(393): rs9), which is herein incorporated by reference in its entirety.
[c] Specificity scores based on Hsu et al (Nature biotechnology, 2013, 31(9): 827-832), Doench et al (Nature Biotechnology, 2014, 32(12): 1262-7), Moreno-Mateos et al (Nature Methods, 2015, 12(10): 982-8), each of which is herein incorporated by reference in its entirety.
d) Number of predicted off-target binding sites in the human genome allowing up to 0, 1, 2, 3 or 4 mismatches, respectively shown in the format 0 - 1 - 2 - 3 - 4. These numbers were corrected to the CCR2 gene as an off-target, therefore, the specificity scores are expected to be higher. Algorithm used: Haeussler et al, Genome Biol. 2016; 17: 148, which is herein incorporated by reference in its entirety.

REFERENCES

1. Komor, A. C.; Kim, Y. B.; Packer, M. S.; Zuris, J. A.; Liu, D. R., Programmable editing of a target base in genomic DNA without double-stranded DNA cleavage. *Nature* 2016, advance online publication.
2. (a) Cong, L.; Ran, F. A.; Cox, D.; Lin, S.; Barretto, R.; Habib, N.; Hsu, P. D.; Wu, X.; Jiang, W.; Marraffini, L. A.; Zhang, F., Multiplex genome engineering using CRISPR/Cas systems. *Science* 2013, 339 (6121), 819-23; (b) Jinek, M.; Chylinski, K.; Fonfara, I.; Hauer, M.; Doudna, J. A.; Charpentier, E., A programmable dual-RNA-guided DNA endonuclease in adaptive bacterial immunity. *Science* 2012, 337 (6096), 816-21; (c) Mali, P.; Yang, L.; Esvelt, K. M.; Aach, J.; Guell, M.; DiCarlo, J. E.; Norville, J. E.; Church, G. M., RNA-guided human genome engineering via Cas9. *Science* 2013, 339 (6121), 823-6.
3. Ran, F. A.; Hsu, P. D.; Lin, C. Y.; Gootenberg, J. S.; Konermann, S.; Trevino, A. E.; Scott, D. A.; Inoue, A.; Matoba, S.; Zhang, Y.; Zhang, F., Double nicking by RNA-guided CRISPR Cas9 for enhanced genome editing specificity. *Cell* 2013, 154 (6), 1380-9.
4. (a) Guilinger, J. P.; Thompson, D. B.; Liu, D. R., Fusion of catalytically inactive Cas9 to FokI nuclease improves the specificity of genome modification. *Nature biotechnology* 2014, 32 (6), 577-82; (b) Tsai, S. Q.; Wyvekens, N.; Khayter, C.; Foden, J. A.; Thapar, V.; Reyon, D.; Goodwin, M. J.; Aryee, M. J.; Joung, J. K., Dimeric CRISPR RNA-guided FokI nucleases for highly specific genome editing. *Nature biotechnology* 2014, 32 (6), 569-76.
5. (a) Capoulade-Metay, C.; Ma, L.; Truong, L. X.; Dudoit, Y.; Versmisse, P.; Nguyen, N. V.; Nguyen, M.; Scott-Algara, D.; Barre-Sinoussi, F.; Debre, P.; Bismuth, G.; Pancino, G.; Theodorou, I., New CCR5 variants associated with reduced HIV coreceptor function in southeast Asia. *AIDS* 2004, 18 (17), 2243-52; (b) Carrington, M.; Kissner, T.; Gerrard, B.; Ivanov, S.; O'Brien, S. J.; Dean, M., Novel alleles of the chemokine-receptor gene CCR5. *American journal of human genetics* 1997, 61 (6), 1261-7; (c) Barmania, F.; Pepper, M. S., C—C chemokine receptor type five (CCR5): An emerging target for the control of HIV infection. *Applied & Translational Genomics* 2013, 2, 3-16; (d) Cox, D. B.; Platt, R. J.; Zhang, F., Therapeutic genome editing: prospects and challenges. *Nature medicine* 2015, 21 (2), 121-31; (e) Dean, M.; Carrington, M.; Winkler, C.; Huttley, G. A.; Smith, M. W.; Allikmets, R.; Goedert, J. J.; Buchbinder, S. P.; Vittinghoff, E.; Gomperts, E.; Donfield, S.; Vlahov, D.; Kaslow, R.; Saah, A.; Rinaldo, C.; Detels, R.; O'Brien, S. J., Genetic restriction of HIV-1 infection and progression to AIDS by a deletion allele of the CKR5 structural gene. Hemophilia Growth and Development Study, Multicenter AIDS Cohort Study, Multicenter Hemophilia Cohort Study, San Francisco City Cohort, ALIVE Study. *Science* 1996, 273 (5283), 1856-62.

6. (a) Lee, B.; Doranz, B. J.; Rana, S.; Yi, Y.; Mellado, M.; Frade, J. M.; Martinez, A. C.; O'Brien, S. J.; Dean, M.; Collman, R. G.; Doms, R. W., Influence of the CCR2-V64I polymorphism on human immunodeficiency virus type 1 coreceptor activity and on chemokine receptor function of CCR2b, CCR3, CCR5, and CXCR4. *Journal of virology* 1998, 72 (9), 7450-8; (b) Apostolakis, S.; Baritaki, S.; Krambovitis, E.; Spandidos, D. A., Distribution of HIV/AIDS protective SDF1, CCR5 and CCR2 gene variants within Cretan population. *Journal of clinical virology: the official publication of the Pan American Society for Clinical Virology* 2005, 34 (4), 310-4; (c) Nakayama, E. E.; Tanaka, Y.; Nagai, Y.; Iwamoto, A.; Shioda, T., A CCR2-V64I polymorphism affects stability of CCR2A isoform. *AIDS* 2004, 18 (5), 729-38.

7. (a) Cradick, T. J.; Fine, E. J.; Antico, C. J.; Bao, G., CRISPR/Cas9 systems targeting β-globin and CCR5 genes have substantial off-target activity. *Nucleic acids research* 2013; (b) Holt, N.; Wang, J.; Kim, K.; Friedman, G.; Wang, X.; Taupin, V.; Crooks, G. M.; Kohn, D. B.; Gregory, P. D.; Holmes, M. C.; Cannon, P. M., Human hematopoietic stem/progenitor cells modified by zinc-finger nucleases targeted to CCR5 control HIV-1 in vivo. *Nature biotechnology* 2010, 28 (8), 839-47.

8. Koonin, E. V.; Novozhilov, A. S., Origin and evolution of the genetic code: the universal enigma. *IUBMB life* 2009, 61 (2), 99-111.

9. (a) Thomas, M. A.; Weston, B.; Joseph, M.; Wu, W.; Nekrutenko, A.; Tonellato, P. J., Evolutionary dynamics of oncogenes and tumor suppressor genes: higher intensities of purifying selection than other genes. *Molecular biology and evolution* 2003, 20 (6), 964-8; (b) Iengar, P., An analysis of substitution, deletion and insertion mutations in cancer genes. *Nucleic acids research* 2012, 40 (14), 6401-13.

All publications, patents, patent applications, publication, and database entries (e.g., sequence database entries) mentioned herein, e.g., in the Background, Summary, Detailed Description, Examples, and/or References sections, are hereby incorporated by reference in their entirety as if each individual publication, patent, patent application, publication, and database entry was specifically and individually incorporated herein by reference. In case of conflict, the present application, including any definitions herein, will control.

EQUIVALENTS AND SCOPE

Those skilled in the art will recognize, or be able to ascertain using no more than routine experimentation, many equivalents of the embodiments described herein. The scope of the present disclosure is not intended to be limited to the above description, but rather is as set forth in the appended claims.

Articles such as "a," "an," and "the" may mean one or more than one unless indicated to the contrary or otherwise evident from the context. Claims or descriptions that include "or" between two or more members of a group are considered satisfied if one, more than one, or all of the group members are present, unless indicated to the contrary or otherwise evident from the context. The disclosure of a group that includes "or" between two or more group members provides embodiments in which exactly one member of the group is present, embodiments in which more than one members of the group are present, and embodiments in which all of the group members are present. For purposes of brevity those embodiments have not been individually spelled out herein, but it will be understood that each of these embodiments is provided herein and may be specifically claimed or disclaimed.

It is to be understood that the instant compositions and methods encompasses all variations, combinations, and permutations in which one or more limitation, element, clause, or descriptive term, from one or more of the claims or from one or more relevant portion of the description, is introduced into another claim. For example, a claim that is dependent on another claim can be modified to include one or more of the limitations found in any other claim that is dependent on the same base claim. Furthermore, where the claims recite a composition, it is to be understood that methods of making or using the composition according to any of the methods of making or using disclosed herein or according to methods known in the art, if any, are included, unless otherwise indicated or unless it would be evident to one of ordinary skill in the art that a contradiction or inconsistency would arise.

Where elements are presented as lists, e.g., in Markush group format, it is to be understood that every possible subgroup of the elements is also disclosed, and that any element or subgroup of elements can be removed from the group. It is also noted that the term "comprising" is intended to be open and permits the inclusion of additional elements or steps. It should be understood that, in general, where an embodiment, product, or method is referred to as comprising particular elements, features, or steps, embodiments, products, or methods that consist, or consist essentially of, such elements, features, or steps, are provided as well. For purposes of brevity those embodiments have not been individually spelled out herein, but it will be understood that each of these embodiments is provided herein and may be specifically claimed or disclaimed.

Where ranges are given, endpoints are included. Furthermore, it is to be understood that unless otherwise indicated or otherwise evident from the context and/or the understanding of one of ordinary skill in the art, values that are expressed as ranges can assume any specific value within the stated ranges in some embodiments, to the tenth of the unit of the lower limit of the range, unless the context clearly dictates otherwise. For purposes of brevity, the values in each range have not been individually spelled out herein, but it will be understood that each of these values is provided herein and may be specifically claimed or disclaimed. It is also to be understood that unless otherwise indicated or otherwise evident from the context and/or the understanding of one of ordinary skill in the art, values expressed as ranges can assume any subrange within the given range, wherein the endpoints of the subrange are expressed to the same degree of accuracy as the tenth of the unit of the lower limit of the range.

In addition, it is to be understood that any particular embodiment of the present compositions and methods may be explicitly excluded from any one or more of the claims. Where ranges are given, any value within the range may explicitly be excluded from any one or more of the claims. Any embodiment, element, feature, application, or aspect of the compositions and/or methods of the disclosure can be excluded from any one or more claims. For purposes of brevity, all of the embodiments in which one or more elements, features, purposes, or aspects is excluded are not set forth explicitly herein.

SEQUENCE LISTING (741 sequences)

SEQ ID NO: 1 - protein, 1368 aa, Streptococcus pyogenes [sequence omitted]

SEQ ID NO: 2 - protein, 1360 aa, Artificial Sequence
  Synthetic Polypeptide
MDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDAIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRI

SEQ ID NO: 3 - protein, 1368 aa, Streptococcus pyogenes
MDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 4 - DNA, 4107 bp, Streptococcus pyogenes
atggataagaaatactcaataggcttagatatcggcacaaatagcgtcggatgggcggtgatcactgatgaatataaggttccgtctaaaaagttcaaggttctgggaaatacagaccgccacagtatcaaaaaaaatcttataggggctcttttatttgacagtggagagacagcggaagcgactcgtctcaaacggacagctcgtagaaggtatacacgtcggaagaatcgtatttgttatctacaggagattttttcaaatgagatggcgaaagtagatgatagtttctttcatcgacttgaagagtcttttttggtggaagaagacaagaagcatgaacgtcatcctatttttggaaatatagtagatgaagttgcttatcatgagaaatatccaactatctatcatctgcgaaaaaaattggtagattctactgataaagcggatttgcgcttaatctatttggccttagcgcatatgattaagtttcgtggtcattttttgattgagggagatttaaatcctgataatagtgatgtggacaaactatttatccagttggtacaaacctacaatcaattatttgaagaaaaccctattaacgcaagtggagtagatgctaaagcgattctttctgcacgattgagtaaatcaagacgattagaaaatctcattgctcagctccccggtgagaagaaaaatggcttatttgggaatctcattgctttgtcattgggtttgacccctaattttaaatcaaattttgatttggcagaagatgctaaattacagctttcaaaagatacttacgatgatgatttagataatttattggcgcaaattggagatcaatatgctgatttgtttttggcagctaagaatttatcagatgctattttactttcagatatcctaagagtaaatactgaaataactaaggctcccctatcagcttcaatgattaaacgctacgatgaacatcatcaagacttgactcttttaaaagctttagttcgacaacaacttccagaaaagtataaagaaatcttttttgatcaatcaaaaaacggatatgcaggttatattgatgggggagctagccaagaagaattttataaatttatcaaaccaattttagaaaaaatggatggtactgaggaattattggtgaaactaaatcgtgaagatttgctgcgcaagcaacggacctttgacaacggctctattccccatcaaattcacttgggtgagctgcatgctattttgagaagacaagaagacttttatccatttttaaaagacaatcgtgagaagattgaaaaaatcttgacttttcgaattccttattatgttggtccattggcgcgtggcaatagtcgttttgcatggatgactcggaagtctgaagaaacaattaccccatggaattttgaagaagttgtcgataaaggtgcttcagctcaatcatttattgaacgcatgacaaactttgataaaaatcttccaaatgaaaaagtactaccaaaacatagtttgctttatgagtattttacggtttataacgaattgacaaaggtcaaatatgttactgaaggaatgcgaaaaccagcatttctttcaggtgaacagaagaaagccattgttgatttactcttcaaaacaaatcgaaaagtaaccgttaagcaattaaaagaagattatttcaaaaaaatagaatgttttgatagtgttgaaatttcaggagttgaagatagatttaatgcttcattaggtacctaccatgatttgctaaaaattattaaagataaagattttttggataatgaagaaaatgaagatatcttagaggatattgttttaacattgaccttatttgaagatagggagatgattgaggaaagacttaaaacatatgctcacctctttgatgataaggtgatgaaacagcttaaacgtcgccgttatactggttggggacgtttgtctcgaaaattgattaatggtattagggataagcaatctggcaaaacaatattagattttttgaaatcagatggttttgccaatcgcaattttatgcagctgatccatgatgatagtttgacatttaaagaagacattcaaaaagcacaagtgtctggacaaggcgatagtttacatgaacatattgcaaatttagctggtagccctgctattaaaaaaggtattttacagactgtaaaagttgttgatgaattggtcaaagtaatggggcggcataagccagaaaatatcgttattgaaatggcacgtgaaaatcagacaactcaaaagggccagaaaaattcgcgagagcgtatgaaacgaatcgaagaaggtatcaaagaattaggaagtcagattcttaaagagcatcctgttgaaaatactcaattgcaaaatgaaaagctctatctctattatctccaaaatggaagagacatgtatgtggaccaagaattagatattaatcgtttaagtgattatgatgtcgatcacattgttccacaaagtttccttaaagacgattcaatagacaataaggtcttaacgcgttctgataaaaatcgtggtaaatcggataacgttccaagtgaagaagtagtcaaaaagatgaaaaactattggagacaacttctaaacgccaagttaatcactcaacgtaagtttgataatttaacgaaagctgaacgtggaggtttgagtgaacttgataaagctggttttatcaaacgccaattggttgaaactcgccaaatcactaagcatgtggcacaaattttggatagtcgcatgaatactaaatacgatgaaaatgataaacttattcgagaggttaaagtgattaccttaaaatctaaattagtttctgacttccgaaaagatttccaattctataaagtacgtgagattaacaattaccatcatgcccatgatgcgtatctaaatgccgtcgttggaactgctttgattaagaaatatccaaaacttgaatcggagtttgtctatggtgattataaagtttatgatgttcgtaaaatgattgctaagtctgagcaagaaataggcaaagcaaccgcaaaatatttcttttactctaatatcatgaacttcttcaaaacagaaattacacttgcaaatggagagattcgcaaacgccctctaatcgaaactaatggggaaactggagaaattgtctgggataaagggcgagattttgccacagtgcgcaaagtattgtccatgccccaagtcaatattgtcaagaaaacagaagtacagacaggcggattctccaaggagtcaattttaccaaaaagaaattcggacaagcttattgctcgtaaaaaagactgggatccaaaaaaatatggtggttttgatagtccaacggtagcttattcagtcctagtggttgctaaggtggaaaaagggaaatcgaagaagttaaaatccgttaaagagttactagggatcacaattatggaaagaagttcctttgaaaaaaatccgattgactttttagaagctaaaggatataaggaagttaaaaaagacttaatcattaaactacctaaatatagtctttttgagttagaaaacggtcgtaaacggatgctggctagtgccggagaattacaaaaaggaaatgagctggctctgccaagcaaatatgtgaattttttatatttagctagtcattatgaaaagttgaagggtagtccagaagataacgaacaaaaacaattgtttgtggagcagcataagcattatttagatgagattattgagcaaatcagtgaattttctaagcgtgttattttagcagatgccaatttagataaagttcttagtgcatataacaaacatagagacaaaccaatacgtgaacaagcagaaaatattattcatttatttacgttgacgaatcttggagctcccgctgcttttaaatattttgatacaacaattgatcgtaaacgatatacgtctacaaaagaagttttagatgccactcttatccatcaatccatcactggtctttatgaaacacgcattgatttgagtcagctaggaggtgactga

SEQ ID NO: 5 - protein, 1053 aa, Staphylococcus aureus
MKRNYILGLDIGITSVGYGIIDYETRDVIDAGVRLFKEANVENNEGRRSKRGARRLKRRRRHRIQRVKKLLFDYNLLTDHSELSGINPYEARVKGLSQKLSEEEFSAALLHLAKRRGVHNVNEVEEDTGNELSTKEQISRNSKALEEKYVAELQLERLKKDGEVRGSINRFKTSDYVKEAKQLLKVQKAYHQLDQSFIDTYIDLLETRRTYYEGPGEGSPFGWKDIKEWYEMLMGHCTYFPEELRSVKYAYNADLYNALNDLNNLVITRDENEKLEYYEKFQIIENVFKQKKKPTLKQIAKEILVNEEDIKGYRVTSTGKPEFTNLKVYHDIKDITARKEIIENAELLDQIAKILTIYQSSEDIQEELTNLNSELTQEEIEQISNLKGYTGTHNLSLKAINLILDELWHTNDNQIAIFNRLKLVPKKVDLSQQKEIPTTLVDDFILSPVVKRSFIQSIKVINAIIKKYGLPNDIIIELAREKNSKDAQKMINEMQKRNRQTNERIEEIIRTTGKENAKYLIEKIKLHDMQEGKCLYSLEAIPLEDLLNNPFNYEVDHIIPRSVSFDNSFNNKVLVKQEENSKKGNRTPFQYLSSSDSKISYETFKKHILNLAKGKGRISKTKKEYLLEERDINRFSVQKDFINRNLVDTRYATRGLMNLLRSYFRVNNLDVKVKSINGGFTSFLRRKWKFKKERNKGYKHHAEDALIIANADFIFKEWKKLDKAKKVMENQMFEEKQAESMPEIETEQEYKEIFITPHQIKHIKDFKDYKYSHRVDKKPNRELINDTLYSTRKDDKGNTLIVNNLNGLYDKDNDKLKKLINKSPEKLLMYHHDPQTYQKLKLIMEQYGDEKNPLYKYYEETGNYLTKYSKKDNGPVIKKIKYYGNKLNAHLDITDDYPNSRNKVVKLSLKPYRFDVYLDNGVYKFVTVKNLDVIKKENYYEVNSKCYEEAKKLKKISNQAEFIASFYNNDLIKINGELYRVIGVNNDLLNRIEVNMIDITYREYLENMNDKRPPRIIKTIASKTQSIKKYSTDILGNLYEVKSKKHPQIIKKG

SEQ ID NO: 6 - protein, 1053 aa, Staphylococcus aureus; identical to SEQ ID NO: 5

SEQ ID NO: 7 - protein, 1368 aa, Streptococcus pyogenes
MDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFVSPTVAYSVLVVAKVEKGKSKKLKSVKELLGITIMERSSFEKNPIDFLEAKGYKEVKKDLIIKLPKYSLFELENGRKRMLASARELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKEYRSTKEVLDATLIHQSITGLYETRIDLSQLGGD

SEQ ID NO: 8 - protein, 1368 aa, Streptococcus pyogenes
MDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFVSPTVAYSVLVVAKVEKGKSKKLKSVKELLGITIMERSSFEKNPIDFLEAKGYKEVKKDLIIKLPKYSLFELENGRKRMLASARELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKEYRSTKEVLDATLIHQSITGLYETRIDLSQLGGD

SEQ ID NO: 9 - protein, 1368 aa, Streptococcus pyogenes
MDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFVSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKQYRSTKEVLDATLIHQSITGLYETRIDLSQLGGD

SEQ ID NO: 10 - skipped

SEQ ID NO: 11 - protein, 1359 aa, Streptococcus pyogenes
MDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 12 - protein, 1355 aa, Streptococcus gallolyticus
MTKKNYSIGLDIGTNSVGWAVITDDYKVPAKKMKVLGNTDKKYIKKNLLGALLFDSGETAEATRLKRTARRRYTRRKNRLRYLQEIFANEIAKVDESFFQRLDESFLTDDDKTFDSHPIFGNKAEEDAYHQKFPTIYHLRKHLADSSEKADLRLVYLALAHMIKFRGHFLIEGELNAENTDVQKIFADFVGVYNRTFDDSHLSEITVDVASILTEKISKSRRLENLIKYYPTEKKNTLFGNLIALALGLQPNFKTNFKLSEDAKLQFSKDTYEEDLEELLGKIGDDYADLFTSAKNLYDAILLSGILTVDDNSTKAPLSASMIKRYVEHHEDLEKLKEFIKANKSELYHDIFKDKNKNGYAGYIENGVKQDEFYKYLKNILSKIKIDGSDYFLDKIEREDFLRKQRTFDNGSIPHQIHLQEMHAILRRQGDYYPFLKEKQDRIEKILTFRIPYYVGPLVRKDSRFAWAEYRSDEKITPWNFDKVIDKEKSAEKFITRMTLNDLYLPEEKVLPKHSHVYETYAVYNELTKIKYVNEQGKESFFDSNMKQEIFDHVFKENRKVTKEKLLNYLNKEFPEYRIKDLIGLDKENKSFNASLGTYHDLKKILDKAFLDDKVNEEVIEDIIKTLTLFEDKDMIHERLQKYSDIFTANQLKKLERRHYTGWGRLSYKLINGIRNKENNKTILDYLIDDGSANRNFMQLINDDTLPFKQIIQKSQVVGDVDDIEAVVHDLPGSPAIKKGILQSVKIVDELVKVMGGNPDNIVIEMARENQTTNRGRSQSQQRLKKLQNSLKPSYIEDKVENSHLQNDQLFLYYIQNGKDMYTGDELDIDHLSDYDIDHIIPQAFIKDDSIDNRVLTSSAKNRGKSDDVPSLDIVRARKAEWVRLYKSGLISKRKFDNLTKAERGGLTEADKAGFIKRQLVETRQITKHVAQILDARFNTEHDENDKVIRDVKVITLKSNLVSQFRKDFEFYKVREINDYHHAHDAYLNAVVGTALLKKYPKLASEFVYGEYKKYDISSDKATAKYFFYSNLMNFFKTKVKYADGTVFERPIIETNADGEIAWNKQIDFEKVRKVLSYPQVNIVKKVETQTGGFSKESILPKGDSDKLIPRKTKKVYWDTKKYGGFDSPTVAYSVFVVADVEKGKAKKLKTVKELVGISIMERSFFEENPVEFLENKGYHNIREDKLIKLPKYSLFEFEGGRRRLLASASELQKGNEMVLPGYLVELLYHAHRADNFNSTEYLNYVSEHKKEFEKVLSCVEDFANLYVDVEKNLSKIRAVADSMDNFSIEEISNSFINLLTLTALGAPADFNFLGEKIPRKRYTSTKECLNATLIHQSITGLYETRIDLSKLGEE

SEQ ID NO: 13 - protein, 1359 aa, Streptococcus mitis
KKGYSIGLDIGTNSVGFAVITDDYKVPSKKMKVLGNTDKRFIKKNLIGALLFDEGTTAEARRLKRTARRRYTRRKNRLRYLQEIFSEEMSKVDSSFFHRLDDSFLIPEDKRESKYPIFATLTEEKEYHKQFPTIYHLRKQLADSKEKTDLRLIYLALAHMIKYRGHFLYEEAFDIKNNDIQKIFNEFISIYDNTFEGSSLSGQNAQVEAIFTDKISKSAKRERVLKLFPDEKSTGLFSEFLKLIVGNQADFKKHFDLEDKAPLQFSKDTYDEDLENLLGQIGDDFTDLFVSAKKLYDAILLSGILTVTDPSTKAPLSASMIERYENHQNDLAALKQFIKNNLPEKYDEVFSDQSKDGYAGYIDGKTTQETFYKYIKNLLSKFEGTDYFLDKIEREDFLRKQRTFDNGSIPHQIHLQEMNAILRRQGEYYPFLKDNKEKIEKILTFRIPYYVGPLARGNRDFAWLTRNSDEAIRPWNFEEIVDKASSAEDFINKMTNYDLYLPEEKVLPKHSLLYETFAVYNELTKVKFIAEGLRDYQFLDSGQKKQIVNQLFKENRKVTEKDIIHYLHNVDGYDGIELKGIEKQFNASLSTYHDLLKIIKDKEFMDDAKNEAILENIVHTLTIFEDREMIKQRLAQYDSLFDEKVIKALTRRHYTGWGKLSAKLINGICDKQTGNTILDYLIDDGKINRNFMQLINDDGLSFKEIIQKAQVIGKTDDVKQVVQELSGSPAIKKGILQSIKIVDELVKVMGHAPESIVIEMARENQTTARGKKNSQQRYKRIEDSLKILASNILKENPTDNNQLQNDRLFLYYLQNGKDMYTGEALDINQLSSYDIDHIIPQAFIKDDSLDNRVLTSSKDNRGKSDNVPSIEVVQKRKAFWQQLLDSKLISERKFNNLTKAERGGLDERDKVGFIKRQLVETRQITKHVAQILDARYNTEVNEKDKKNRTVKIITLKSNLVSNFRKEFRLYKVREINDYHHAHDAYLNAVVAKAILKKYPKLEPEFVYGEYQKYDLSKDPKEVEKATEKYFFYSNLLNFFKEEVHYADGTIVKRENIEYSKDTGEIAWNKEKDFAIIKKVLSLPQVNIVKKREVQTGGFSKESILPKGNSDKLIPRKTKDILLDTTKYGGFDSPVIAYSILLIADIEKGKAKKLKTVKTLVGITIMEKAAFEENPITFLENKGYHNVRKENILCLPKYSLFELENGRRRLLASAKELQKGNEIVLPVYLTTLLYHSKNVHKLDEPGHLEYIQKHRNEFKDLLNLVSEFSQKYVLADANLEKIKSLYADNEQADIEILANSFINLLTFTALGAPAAFKFFGKDIDRKRYTTVSEILNATLIHQSITGLYETWIDLSKLGED

SEQ ID NO: 14 - protein, 986 aa, Staphylococcus Aureus
MKRNYILGLDIGITSVGYGIIDYETRDVIDAGVRLFKEANVENNEGRRSKRGARRLKRRRRHRIQRVKKLLFDYNLLTDHSELSGNPYEARVKGLSQKLSEEEFSAALLHLAKRRGVHNVNEVEEDTGNELSTKEQISRNSKLEEKYVAELQLERLKKDGEVRGSINRKTSDYVKEAKQLLKVQKAYHQLDQSFIDTYIDLLETRRTYYEGPGEGSPFGWKDIKEWYEMLMGHCTYFPEELRSVKYAYNADLYNALNDLNNLVITRDENEKLEYYEKFQIIENVFKQKKKPTLKQIAKEILVNEEDIKGYRVTSTGKPEFTNLKVYHDIKDITARKENAELLDQIAKILTIYQSSEDIQEELTNLNSELTQEEIEQISNLKGYTGTHNLSLKAINLILDELWTNDNQIAIFNRLKLVPKKVDLSQQKEIPTTLVDDFILSPVVKRSFIQSIKVINAIIKKYGLPNDIIIELAREKNSKDAQKMINEMQKQTNEEIIRTTGKENAKYLIEKIKLHDMQEGKCLYSLEAIPLEDLLNNPFNYEVDHIIPRSVSFDNSFNNKVLVKQEEASKKGNRTPFQYLSSSDSKISYETFKKHILNLAKGKGRISKTKKEYLLEERDQKDFINRNLVDTRYATRGLMNLLRSYFRVNNLDVKVKSINGGFTSFLRRKWKFKKERNKGYKHHAEDALIIANADFIFKEWKKLDKNQMFEEKETEQEYKEIFITPHQIKHIKDFKDYKYSHRVDKKPNREVNNLNGLYDKDNDKLKKLINKSPEKLLMYHHDPQTYQKKLIMEQYGDEKNLYKYYEETGNYLTKYSKKDNGPVIKKIKYYGNKLNAHLDITDDYPNSVKLSLKPYRFDVYLDNGVYKFVTVKNLDVIKKENYYEVNSKAYEEAKKKKISNQAEFIASFYNNDLIKINGELYRVIGVNNDLLNRIEVNMIDITYREYLENMNDKRPPRIIKTIASKTQSIKKLYEVKSKKHPQIIKKG

SEQ ID NO: 15 - protein, 1044 aa, Streptococcus pyogenes
LSASMIKRYDEHHQDLTLLKALVRQQLPEKYKEIFFDQSKNGYAGYIDGGASQEEFYKFIKPILEKMDGTEELLAKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKDGFANRNFMQLIHDDSLTFKEDLQKAQVSGQGDSLHEHIANLAGSPAIKKGILQTVKVVDELVKVMGRHKPENIVIEMARENQTTQKGQKNSRERMKRIEEGIKELGSDILKEYPVENTQLQNEKLYLYYLQNGRDMYVDQELDINRLSDYDVDHIVPQSFLKDDSIDNKVLTRSDKNRGKSDNVPSEEVVKKMKNYWKQLLNAKLITQRKFDNLTKAERGGLSELDKAGFIKRQLVETRQITKHVAQILDSRMNTKYDENDKLIREVRVITLKSKLVSDFRKDFQFYKVREINNYHHAHDAYLNAVVGTALIKKYPKLESEFVYGDYKVYDISEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELVGITIMERSSFEKDPVDFLEAKGYKEVRKDLIIKLPKYSLFELENGRKRMLASGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKCFDTTIGRNRYKSIKEVLDATLIHQSITGLYETRIDLSQLGGD

SEQ ID NO: 16 - protein, 1359 aa, Streptococcus pyogenes; identical to SEQ ID NO: 11

SEQ ID NO: 17 - protein, 1359 aa, Streptococcus pyogenes
MDKKYSIGLDIGTNSVGWAVITDDYKVPSKKLKGLGNTDRHGIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLADSTDKVDLRLIYLALAHMIKFRGHFLIEGDLNPDNSDVDKLFIQLVQTYNQLFEENINASRVDAKAILSARLSKSRRLENLIAQLPGEKKNGLFGNLIALSLGLTPNFKSNFDLAEDAKLQLSKDTYDDDLDNLLAQIGDQYADLFLAAKNLSDATLLSDILRVNSEITKAPLSASMIKRYDEHHQDLTLLKALVRQQLPEKYKEIFFDQSKNGYAGYIDGGASQEEFYKFIKPILEKMDGTEELLAKLNREDLLRKQRTFDNGSIPYQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSDILKEYPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKVGFIKRQLVETRQITKHVAQILDSRMNTKYDENDKLIREVRVITLKSKLVSDFRKDFQFYKVREINNYHHAHDAYLNAVVGTALIKKYPKLESEFVYGDYKVYDVSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKDPIDFLEAKGYKEVRKDLIIKLPKYSLFELENGRKRMLASGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 18 - protein, 1359 aa, Streptococcus pyogenes
MDKKYSIGLDIGTNSVGWAVITDDYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRLNSEITKAPLSASMIKRYDEHHQDLTLLKALVRQQLPEKYKEIFFDQSKNGYAGYIDGGASQEEFYKFIKPILEKMDGTEELLAKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFIKDDSIDNKVLTRSDKNRGKSNNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVRKDLIVKLPKYSLFELENGRKRMLASGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATFIHQSITGLYETRIDLSQLGGD

SEQ ID NO: 19 - protein, 1359 aa, Streptococcus pyogenes
MDKKYSIGLDIGTNSVGWAVITDDYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 20 - protein, 1359 aa, Streptococcus pyogenes
MDKKYSIGLDIGTNSVGWAVITDDYKVPSKKFKVLGNTDRHSIKKNLIGALLFDSGEIAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRLNSEITKAPLSASMIKRYDEHHQDLTLLKALVRQQLPEKYKEIFFDQSKNGYAGYIDGGASQEEFYKFIKPILEKMDGTEELLAKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTVWGRLSRKLINGIRDKQSGKTILDFLKDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFIKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVRKDLIIKLPKYSLFELENGRKRMLASGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPTAFKYFDTTIDRKRYTSTKEVLDATFIHQSITGLYETRIDLSQLGGD

SEQ ID NO: 21 - protein, 1359 aa, Streptococcus pyogenes
MDKKYSIGLDIGTNSVGWAVITDDYKVPSKKFKVLGNTDRHSIKKNLIGALLFDSGETAEATRLKRTARRRYTRRKNRICYLQEIFSNEIAKVDDSFFHRLEESFLVEEDKKHERHPIFGNIVDEVAYHEKYPTIYHLRKKLADSTDKADLRLIYLALAHMIKFRGHFLIEGDLNPDNSDVDKLFIQLVQTYNQLFEENINASRVDAKAILSARLSKSRRLENLIAQLPGEKRNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLAKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKDGFANRNFMQLIHDDSLTFKEDLQKAQVSGQGDSLHEHIANLAGSPAIKKGILQTVKVVDELVKVMGRHKPENIVIEMARENQTTQKGQKNSRERMKRIEEGIKELGSDILKEYPVETTQLQNEKLYLYYLQNGRDMYVDQELDINRLSDYDVDHIVPQSFLKDDSIDNKVLTRSDKNRGKSDNVPSEEVVKKMKNYWKQLLNAKLITQRKFDNLTKAERGGLSELDKAGFIKRQLVETRQITKHVAQILDSRMNTKYDENDKLIREVRVITLKSKLVSDFRKDFQFYKVREINNYHHAHDAYLNAVVGTALIKKYPKLESEFVYGDYKVYDISEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELVGITIMERSSFEKDPVDFLEAKGYKEVRKDLIIKLPKYSLFELENGRKRMLASGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKCFDTTIGRNRYKSIKEVLDATLIHQSITGLYETRIDLSQLGGD

SEQ ID NO: 22 - protein, 1358 aa, Streptococcus pyogenes
MDKKYSIGLDIGTNSVGWAVITDDYKVPSKKFKVLGNTDRHSIKKNLIGALLFGSGETAEATRLKRTARRRYTRRKNRICYLQEIFSNEMAKVDDSFFHRLEESFLVEEDKKHERHPIFGNIVDEVAYHEKYPTIYHLRKKLADSTDKADLRLIYLALAHMIKFRGHFLIEGDLNPDNSDVDKLFIQLVQIYNQLFEENINASRVDAKAILSARLSKSRRLENLIAQLPGEKRNGLFGNLIALSLGLTPNFKSNFDLAEDAKLQLSKDTYDDDLDNLLAQIGDQYADLFLAAKNLSDAILLSDILRVNSEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGAYHDLLKIIKDKDFLDNEENEDILEDIVLTLTLFEDRGMIEERLKTYAHLFDDKVMKQLKRRRYTGWGRLSRKLINGIRDKQSGKTILDFLKDGFANRNFMQLIHDDSLTFKEDIQKAQVSGQGHSLHEQIANLAGSPAIKKGILQTVKIVDELVKVMGHKPENIVIEMARENQTTQKGQKNSRERMKRIEEGIKELGSQILKEHPVENTQLQNEKLYLYYLQNGRDMYVDQELDINRLSDYDVDHIVPQSFIKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 23 - protein, 1359 aa, Streptococcus pyogenes
MDKKYSIGLDIGTNSVGWAVITDDYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRLNSEITKAPLSASMIKRYDEHHQDLTLLKALVRQQLPEKYKEIFFDQSKNGYAGYIDGGASQEEFYKFIKPILEKMDGTEELLAKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFIKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGLTIMERSSFEKNPIDFLEAKGYKEVKKDLIIKLPKYSLFELENGRKRMLASGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 24 - protein, 1358 aa, Streptococcus pyogenes
MDKKYSIGLDIGTNSVGWAVITDDYKVPSKKLKVLGNTDRHGIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLADSTDKVDLRLIYLALAHMIKFRGHFLIEGDLNPDNSDVDKLFIQLVQTYNQLFEENINASRVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNSEITKAPLSASMIKRYDEHHQDLTLLKALVRQQLPEKYKEIFFDQSKNGYAGYIDGGASQEEFYKFIKPILEKMDGTEELLAKLNREDLLRKQRTFDNGSIPYQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNTSLGTYHDLLKIIKDKDFLDNEENEDILEDIVLTLTLFEDKEMIEERLKKYANLFDDKVMKQLKRRHYTGWGRLSRKLINGIRDKQSGKTILDFLKDGFANRNFMQLINDDSLTFKEAIQKAQVSGQGHSLHEQIANLAGSPAIKKGILQTVKIVDELVKVMGHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVRKDLIIKLPKYSLFELENGRKRMLASGELQKGNELALPSKYVNFLYLASHYEKLKGSPEDNEQKQLFVEQHKHYLDEIIEQISEFSKRVILADANLDKVLSAYNKHRDKPIREQAKNIIHLFTLTNLGAPAAFKYFDTTIERNRYKSIKEVLDATLIHQSITGLYETRIDLSQLGGD

SEQ ID NO: 25 - protein, 1358 aa, Streptococcus pyogenes
MDKKYSIGLDIGTNSVGWAVITDDYKVPSKKLKVLGNTDRHGIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLADSTDKVDLRLIYLALAHMIKFRGHFLIEGDLNPDNSDVDKLFIQLVQTYNQLFEENINASRVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNSEITKAPLSASMIKRYDEHHQDLTLLKALVRQQLPEKYKEIFFDQSKNGYAGYIDGGASQEEFYKFIKPILEKMDGTEELLAKLNREDLLRKQRTFDNGSIPYQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNTSLGTYHDLLKIIKDKDFLDNEENEDILEDIVLTLTLFEDKEMIEERLKKYANLFDDKVMKQLKRRHYTGWGRLSRKLINGIRDKQSGKTILDFLKDGFANRNFMQLINDDSLTFKEAIQKAQVSGQGHSLHEQIANLAGSPAIKKGILQTVKIVDELVKVMGHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVRKDLIIKLPKYSLFELENGRKRMLASGELQKGNELALPSKYVNFLYLASHYEKLKGSPEDNEQKQLFVEQHKHYLDEIIEQISEFSKRVILADANLDKVLSAYNKHRDKPIREQAKNIIHLFTLTNLGAPAAFKYFDTTIERNRYKSIKEVLDATLIHQSITGLYEIRIDLSQLGGD

SEQ ID NO: 26 - protein, 1359 aa, Streptococcus pyogenes
MDKKYSIGLDIGTNSVGWAVITDDYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKASLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKDGFANRNFMQLIHDDSLTFKEDLQKAQVSGQGDSLHEHIANLAGSPAIKKGILQTVKVVDELVKVMGRHKPENIVIEMARENQTTQKGQKNSRERMKRIEEGIKELGSDILKEYPVENTQLQNEKLYLYYLQNGRDMYVDQELDINRLSDYDVDHIVPQSFIKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVRKDLIIKLPKYSLFELENGRKRMLASGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIGRNRYKSIKEVLDATLIHQSITGLYETRIDLSQLGGD

SEQ ID NO: 27 - protein, 1359 aa, Streptococcus pyogenes
MDKKYSIGLDIGTNSVGWAVITDDYKVPSKKFKVLGNTDRHGIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLADSTDKVDLRLIYLALAHMIKFRGHFLIEGDLNPDNSDVDKLFIQLVQTYNQLFEENINASRVDAKAILSARLSKSRRLENLIAQLPGEKKNGLFGNLIALSLGLTPNFKSNFDLAEDAKLQLSKDTYDDDLDNLLAQIGDQYADLFLAAKNLSDATLLSDILRVNSEITKAPLSASMIKRYDEHHQDLTLLKALVRQQLPEKYKEIFFDQSKNGYAGYIDGGASQEEFYKFIKPILEKMDGTEELLAKLNREDLLRKQRTFDNGSIPYQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSDILKEYPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVRKDLIIKLPKYSLFELENGRKRMLASGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 28 - protein, 1359 aa, Streptococcus pyogenes
MDKKYSIGLDIGTNSVGWAVITDDYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLADSTDKADLRLIYLALAHMIKFRGHFLIEGDLNPDNSDVDKLFIQLVQTYNQLFEENINASRVDAKAILSARLSKSRRLENLIAQLPGEKRNGLFGNLIALSLGLTPNFKSNFDLAEDAKLQLSKDTYDDDLDNLLAQIGDQYADLFLAAKNLSDAILLSDILRVNSEITKAPLSASMIKRYDEHHQDLTLLKALVRQQLPEKYKEIFFDQSKNGYAGYIDGGASQEEFYKFIKPILEKMDGTEELLAKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPEFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSDILKEYPVENTQLQNEKLYLYYLQNGRDMYVDQELDINRLSDYDVDHIVPQSFIKDDSIDNKVLTRSDKNRGKSDNVPSEEVVKKMKNYWKQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVRKDLIIKLPKYSLFELENGRKRMLASGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNFGAPAAFIYFDTTIGRNRYKSIKEVLDATLIHQSITGLYETRIDLSQLGGD

SEQ ID NO: 29 - protein, 1359 aa, Streptococcus pyogenes
MDKKYSIGLDIGTNSVGWAVITDDYKVPSKKFKVLGNTDRHSIKKNLIGALLFDSGETAEATRLKRTARRRYTRRKNRICYLQEIFSNEIAKVDDSFFHRLEESFLVEEDKKHERHPIFGNIVDEVAYHEKYPTIYHLRKKLADSTDKADLRLIYLALAHMIKFRGHFLIEGDLNPDNSDVDKLFIQLVQTYNQLFEENINASRVDAKAILSARLSKSRRLENLIAQLPGEKRNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLAKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKDGFANRNFMQLIHDDSLTFKEDLQKAQVSGQGDSLHEHIANLAGSPAIKKGILQTVKVVDELVKVMGRHKPENIVIEMARENQTTQKGQKNSRERMKRIEEGIKELGSDILKEYPVENTQLQNEKLYLYYLQNGRDMYVDQELDINRLSDYDVDHIVPQSFLKDDSIDNKVLTRSDKNRGKSDNVPSEEVVKKMKNYWKQLLNAKLITQRKFDNLTKAERGGLSELDKAGFIKRQLVETRQITKHVAQILDSRMNTKYDENDKLIREVRVITLKSKLVSDFRKDFQFYKVREINNYHHAHDAYLNAVVGTALIKKYPKLESEFVYGDYKVYDISEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELVGITIMERSSFEKDPVDFLEAKGYKEVRKDLIIKLPKYSLFELENGRKRMLASGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIGRNRYKSIKEVLDATLIHQSITGLYETRIDLSQLGGD

SEQ ID NO: 30 - protein, 1359 aa, Streptococcus pyogenes
MDKKYSIGLDIGTNSVGWAVITDDYKVPSKKFKVLGNTDRHSIKKNLIGALLFDSGETAEATRLKRTARRRYTRRKNRICYLQEIFSNEIAKVDDSFFHRLEESFLVEEDKKHERHPIFGNIVDEVAYHEKYPTIYHLRKKLADSTDKADLRLIYLALAHMIKFRGHFLIEGGLNPDNSDVDKLFIQLVQTYNQLFEENINASRVDAKAILSARLSKSRRLENLIAQLPGEKRNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLAKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKDGFANRNFMQLIHDDSLTFKEDLQKAQVSGQGDSLHEHIANLAGSPAIKKGILQTVKVVDELVKVMGRHKPENIVIEMARENQTTQKGQKNSRERMKRIEEGIKELGSDILKEYPVENTQLQNEKLYLYYLQNGRDMYVDQELDINRLSDYDVDHIVPQSFLKDDSIDNKVLTRSDKNRGKSDNVPSEEVVKKMKNYWKQLLNAKLITQRKFDNLTKAERGGLSELDKAGFIKRQLVETRQITKHVAQILDSRMNTKYDENDKLIREVRVITLKSKLVSDFRKDFQFYKVREINNYHHAHDAYLNAVVGTALIKKYPKLESEFVYGDYKVYDISEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELVGITIMERSSFEKDPVDFLEAKGYKEVRKDLIIKLPKYSLFELENGRKRMLASGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIGRNRYKSIKEVLDATLIHQSITGLYETRIDLSQLGGD

SEQ ID NO: 31 - protein, 1359 aa, Streptococcus pyogenes
MDKKYSIGLDIGTNSVGWAVITDDYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENINANGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 32 - protein, 1359 aa, Streptococcus pyogenes
MDKKYSIGLDIGTNSVGWAVITDDYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLADSTDKADLRLIYLALAHMIKFRGHFLIEGDLNPDNSDVDKLFIQLVQTYNQLFEENINASRVDAKAILSARLSKSRRLENLIAQLPGEKKNGLFGNLIALLLGLTPNFKSNFDLAEDAKLQLSKDTYDDDLDNLLAQIGDQYADLFLAAKNLSDAILLSDILRVNSEITKAPLSASMIKRYDEHHQDLTLLKALVRQQLPEKYKEIFFDQSKNGYAGYIDGGASQEEFYKFIKPILEKMDGTEELLAKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDKEMIEERLKKYAHLFDDKVMKQLKRRRYTGWGRLSRKLINGIRDKQSGKTILDFLKDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSDILKEYPVENTQLQNEKLYLYYLQNGRDMYVDQELDINRLSDYDVDHIVPQSFLKDDSIDNKVLTRSDKNRGKSDNVPSEEVVKKMKNYWKQLLNAKLITQRKFDNLTKAERGGLSELDKAGFIKRQLVETRQITKHVAQILDSRMNTKYDENDKLIREVRVITLKSKLVSDFRKDFQFYKVREINNYHHAHDAYLNAVVGTALIKKYPKLESEFVYGDYKVYDVSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVRKDLIIKLPKYSLFELENGRKRMLASGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 33 - protein, 1359 aa, Streptococcus pyogenes
MDKKYSIGLDIGTNSVGWAVITDDYKVPSKKFKVLGNTDRHSIKKNLIGALLFDSGEIAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRLNSEITKAPLSASMIKRYDEHHQDLTLLKALVRQQLPEKYKEIFFDQSKNGYAGYIDGGASQEEFYKFIKPILEKMDGTEELLAKLNRKDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFIKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVRKDLIIKLPKYSLFELENGRKRMLASGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPTAFKYFDTTIDRKRYTSTKEVLDATFIHQSITGLYETRIDLSQLGGD

SEQ ID NO: 34 - protein, 1184 aa, Streptococcus pyogenes
PDNSDVDKLFIQLVQTYNQLFEENINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 35 - protein, 1359 aa, Streptococcus pyogenes
MDKKYSIGLDIGTNSVGWAVITDDYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLADSTDKADLRLIYLALAHMIKFRGHFLIEGDLNPDNSDVDKLFIQLVQTYNQLFEENINASRVDAKAILSARLSKSRRLENLIAQLPGEKKNGLFGNLIALSLGLTPNFKSNFDLAEDAKLQLSKDTYDDDLDNLLAQIGDQYADLFLAAKNLSDATLLSDILRVNSEITKAPLSASMIKRYDEHHQDLTLLKALVRQQLPEKYKEIFFDQSKNGYAGYIDGGASQEEFYKFIKPILEKMDGTEELLAKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSDILKEYPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVRKDLIIKLPKYSLFELENGRKRMLASGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 36 - protein, 1358 aa, Streptococcus pyogenes
MDKKYSIGLDIGTNSVGWAVITDDYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLADSTDKVDLRLIYLALAHMIKFRGHFLIEGDLNPDNSDVDKLFIQLVQTYNQLFEENINASRVDAKAILSARLSKSRRLENLIAQLPGEKKNGLFGNLIALSLGLTPNFKSNFDLAEDTKLQLSKDTYDDDLDNLLAQIGDQYADLFLAAKNLSDAILLSDILRVNSEITKAPLSASMIKRYDEHHQDLTLLKALVRQQLPEKYKEIFFDQSKNGYAGYIDGGASQEEFYKFIKPILEKMDGTEELLAKLNREDLLRKQRTFDNGSIPYQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNTSLGTYHDLLKIIKDKDFLDNEENEDILEDIVLTLTLFEDKEMIEERLKKYANLFDDKVMKQLKRRHYTGWGRLSRKLINGIRDKQSGKTILDFLKDGFANRNFMQLINDDSLTFKEAIQKAQVSGQGHSLHEQIANLAGSPAIKKGILQTVKIVDELVKVMGHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVRKDLIIKLPKYSLFELENGRKRMLASGELQKGNELALPSKYVNFLYLASHYEKLKGSPEDNEQKQLFVEQHKHYLDEIIEQISEFSKRVILADANLDKVLSAYNKHRDKPIREQAKNIIHLFTLTNLGAPAAFKYFDTTIERNRYKSIKEVLDATLIHQSITGLYETRIDLSQLGGD

SEQ ID NO: 37 - protein, 1359 aa, Streptococcus pyogenes
MDKKYSIGLDIGTNSVGWAVITDDYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLADSTDKADLRLIYLALAHMIKFRGHFLIEGDLNPDNSDVDKLFIQLVQTYNQLFEENINASRVDAKAILSARLSKSRRLENLIAQLPGEKRNGLFGNLIALSLGLTPNFKSNFDLAEDAKLQLSKDTYDDDLDNLLAQIGDQYADLFLAAKNLSDAILLSDILRVNSEITKAPLSASMIKRYDEHHQDLTLLKALVRQQLPEKYKEIFFDQSKNGYAGYIDGGASQEEFYKFIKPILEKMDGTEELLAKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKDGFANRNFMQLIHDDSLTFKEDIQKAQVSGQGDSLHEHIANLAGSPAIKKGILQTVKIVDELVKVMGRHKPENIVIEMARENQTTQKGQKNSRERMKRIEEGIKELGSDILKEYPVENTQLQNEKLYLYYLQNGRDMYVDQELDINRLSDYDVDHIVPQSFLKDDSIDNKVLTRSDKNRGKSDNVPSEEVVKKMKNYWKQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVRKDLIIKLPKYSLFELENGRKRMLASGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIGRNRYKSIKEVLDATLIHQSITGLYETRIDLSQLGGD

SEQ ID NO: 38 - protein, 1270 aa, Streptococcus pyogenes
MAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 39 - protein, 536 aa, Streptococcus pyogenes
QELDINRLSGYDVDHIVPQSFLKDDSIDNKVLTRSDKNRGKSDNVPSEEVVKKMKNYWRQLLNAKLITQRKFDNLTKAERGGLSELDKVGFIKRQLVETRQITKHVAQILDSRMNTKYDENDKLIREVRVITLKSKLVSDFRKDFQFYKVREINNYHHAHDAYLNAVVGTALIKKYPKLESEFVYGDYKVYDVSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKDPIDFLEAKGYKEVRKDLIIKLPKYSLFELENGRKRMLASGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 40 - protein, 305 aa, Streptococcus pyogenes
IETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKDPIDFLEAKGYKEVRKDLIIKLPKYSLFELENGRKRMLASGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 41 - protein, 1359 aa, Artificial Sequence
  Synthetic Polypeptide
MDKKYSIGLDIGTNSVGWAVITDDYKVPSKKFKVLGNTDRHSIKKNLIGALLFDSGEIAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRLNSEITKAPLSASMIKRYDEHHQDLTLLKALVRQQLPEKYKEIFFDQSKNGYAGYIDGGASQEEFYKFIKPILEKMDGTEELLAKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFIKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVRKDLIIKLPKYSLFELENGRKRMLASGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPTAFKYFDTTIDRKRYTSTKEVLDATFIHQSITGLYETRIDLSQLGGD

SEQ ID NO: 42 - protein, 1341 aa, Artificial Sequence
  Synthetic Polypeptide
MDQKYSIGLDIGTNSVGWAVVTDDYKVPAKKMKVLGNTDKQSIKKNLLGALLFDSGETAEATRLKRTARRRYTRRRNRLRYLQEIFAEEMNKVDENFFQRLDDSFLVDEDKRGERHPIFGNIAAEVKYHDDFPTIYHLRKHLADISQKADLRLVYLALAHMIKFRGHFLIEGQLKAENTNVQALFKDFVEVYDKTVEESHLSEMTVDALSILTEKVSKSRRLENLIAHYPAEKKNTLFGNLIALSLGLQPNFKTNFQLSEDAKLQFSKDTYEEDLEGLLGEIGDEYADLFASAKNLYDAILLSGILTVDDNSTKAPLSASMVKRYEEHQKDLKKLKDFIKVNAPDQYNAIFKDKNKKGYAGYIENGVKQDEFYKYLKGILLQINGSGDFLDKIDREDFLRKQRTFDNGSIPHQIHLQEMHAILRRQEEHYPFLKENQDKIEKILTFRIPYYVGPLARKGSRFAWAEYKADEKITPWNFDDILDKEKSAEKFITRMTLNDLYLPEEKVLPKHSLLYETFTVYNELTKVKYVNEQGEAKFFDANMKQEIFDHVFKENRKVTKDKLLNYLNKEFEEFRIVNLTGLDKENKAFNSSLGTYHDLRKILDKSFLDDKANEKTIEDIIQTLTLFEDREMIRQRLQKYSDIFTKAQLKKLERRHYTGWGRLSYKLINGIRNKENKKTILDYLIDDGYANRNFMQLINDDALSFKEEIARAQIIGDVDDIANVVHDLPGSPAIKKGILQSVKIVDELVKVMGHNPANIIIEMARENQMTDKGRRNSQQRLKLLQDSLKPVNIKNVENQQLQNDRLFLYYIQNGKDMYTGETLDINNLSQYDIDHIIPQAFIKDNSLDNRVLTRSDKNRGKSDDVPSIEVVHEMKSFWSKLLSVKLITQRKFDNLTKAERGGLTEEDKAGFIKRQLVETRQITKHVAQILDERFNTEFDGNKRRIRNVKIITLKSNLVSNFRKEFELYKVREINDYHHAHDAYLNAVVGNALLLKYPQLEPEFVYGEYPKYNSYRSRKSATEKFLFYSNILRFFKKEDIQTNEDGEIAWNKEKHIKILRKVLSYPQVNIVKKTEEQTGGFSKESILPKGESDKLIPRKTKNSYWNPKKYGGFDSPVVAYSILVFADVEKGKSKKLRKVQDMVGITIMEKKRFEKHPVDFLEQRGYRNVRLEKIIKLPKYSLFELENKRRRLLASARELQKGNELVIPQRFTTLLYHSYQIEKNYEPEHREYVEKHKDEFKELLEYISVFSRKYVLADNNLTKIEMLFSKNKDAEVSSLAKSFISLLTFTAFGAPAAFNFFGENIDRKRYTSVTECLNATLIHQSITGLYETRIDLSKLGED

SEQ ID NO: 43 - protein, 1356 aa, Artificial Sequence
  Synthetic Polypeptide
MTKKNYSIGLDIGTNSVGWAVITDDYKVPAKKMKVLGNTDKKYIKKNLLGALLFDSGETAEATRLKRTARRRYTRRKNRLRYLQEIFAEEMTKVDESFFQRLDESFLRWDDDNKKLGRYPIFGNKADVVKYHQEFPTIYHLRKHLADSSEKADLRLVYLALAHMIKFRGHFLIEGELNAENTDVQKIFADFVGVYDRTFDDSHLSEITVDAASILTEKISKSRRLENLIKYYPTEKKNTLFGNLIALALGLQPNFKMNFKLSEDAKLQFSKDSYEEDLGELLGKIGDDYADLFTSAKNLYDAILLSGILIVDDNSTKAPLSASMIKRYVEHQEDLEKLKEFIKANKSELYHDIFKDKNKNGYAGYIENGVKQDEFYKYLKNTLSKIAGSDYFLDKIEREDFLRKQRTFDNGSIPHQIHLQEMHAILRRQGDYYPFLKENQDRIEKILTFRIPYYVGPLARKDSRFSWAEYHSDEKITPWNFDKVIDKEKSAEKFITRMTLNDLYLPEEKVLPKHSHVYETYAVYNELTKIKYVNEQGKDSFFDSNMKQEIFDHVFKENRKVTKEKLLNYLNKEFPEYRIKDLIGLDKENKSFNASLGTYHDLKKILDKAFLDDKVNEEVIEDIIKTLTLFEDKDMIHERLQKYSDIFTADQLKKLERRHYTGWGRLSYKLINGIRNKENNKTILDYLIDDGSANRNFMQLINDDTLPFKQIIQKSQVVGDVDDIEAVVHDLPGSPAIKKGILQSVKIVDELVKVMGDNPDNIVIEMARENQTTNRGRSQSQQRLKKLQNSLKPSYIEDKVENSHLQNDQLFLYYIQNGKDMYTGDELDIDHLSDYDIDHIIPQAFIKDDSIDNRVLTSSAKNRGKSDDVPSLDIVRARKAEWVRLYKSGLISKRKFDNLTKAERGGLTEADKAGFIKRQLVETRQITKHVAQILDARFNTESDENDKVIRDVKVITLKSNLVSQFRKDFEFYKVREINDYHHAHDAYLNAVVGTALLKKYPKLASEFVYGEYKKYDISSDKATAKYFFYSNLMNFFKRVIRYSNGKVIVRPVVEYSKDTEDIAWDKKSNFRTICKVLSYPQVNIVKKVETQTGGFSKESILPKGDSDKLIPRKTKKAYWDTKKYGGFDSPTVAYSVFVVADVEKGKAKKLKTVKELVGISIMERSFFEENPVEFLENKGYHNIREDKLIKLPKYSLFEFEGGKRRLLASASELQKGNEMVIPGHLVKLLYHAQRINSFNSTKYLDYVSAHKKEFEKVLSCVEDFANLYVDVEKNLSKIRAVADSMDNFSIEEISNSFINLLTLTALGAPADFNFLGEKIPRKRYTSTKECLNATLIHQSITGLYETRIDLSKIGEE

SEQ ID NO: 44 - protein, 1365 aa, Streptococcus agalactiae
MNKPYSIGLDIGTNSVGWSIITDDYKVPAKKIRVLGNTDKEYIKKNLIGALLFDGGNTAADRRLKRTARRRYTRRRNRILYLQEIFAEEMSKVDDSFFHRLEDSFLVEEDKRGSKYPIFATLQEEKYYHEKFPTIYHLRKELADKKEKADLRLVYLALAHIIKFRGHFLIEDDRFDVRNTDIQKQYQAFLEIFDTTFENNDLLSQDVDVEAILTDKISKSAKKDRILAQYPNQKSTGIFAEFLKLIVGNQADFKKHFNLEDKTPLQFAKDSYDEDLENLLGQIGDEFADLFSAAKKLYDSVLLSGILTVTDLSTKAPLSASMIQRYDEHREDLKQLKQFVKASLPEKYQEIVADSSKDGYAGYIEGKTNQEAFYKYLSKLLTKQEGSEYFLEKIKNEDFLRKQRTFDNGSIPHQVHLTELRAIIRRQSEYYPFLKENLDRIEKILTFRIPYYVGPLAREKSDFAWMTRKTDDSIRPWNFEDLVDKEKSAEAFIHRMTNNDLYLPEEKVLPKHSLIYEKFTVYNELTKVRFLAEGFKDFQFLNRKQKETIFNSLFKEKRKVTEKDIISFLNKVDGYEGIAIKGIEKQFNASLSTYHDLKKILGKDFLDNTDNELILEDIVQTLTLFEDREMIKKRLDIYKDFFTESQLKKLYRRHYTGWGRLSAKLINGIRNKENQKTILDYLIDDGSANRNFMQLIKDAGLSFKPIIDKARTGSHSDNLKEVIGELAGSPAIKKGILQSLKIVDELVKVMGYEPEQIVVEMARENQTTAKGLSRSRQRLTTLRESLANLKSEKKPKYVKDQVENHHLSDDRLFLYYLQNGKDMYTDDELDIDNLSQYDIDHIIPQAFIKDDSIDNRVLVSSAKNRGKSDDVPSLEIVKDCKVFWKKLLDAKLMSQRKYDNLTKAERGGLTSDDKARFIQRQLVETRQITKHVARILDERFNNELDSKGRRIRKVKIVTLKSNLVSNFRKEFVFYKIREVNNYHHAHDAYLNAVVAKAILTKYPQLEPEFVYGDYPKYNSYKTRKATEKLFFYSNIMNFFKTKVTLADGTVVVKDDIEVNNDTGEIVWDKKKHFATVRKVLSYPQVNIVKKTEIQTGGFSKESILAHGNSDKLIPRKTKDIYLDPKKYGGFDSPIVAYSVLVVADIKKGKAQKLKTVTELLGITIMERSRFEKNPSAFLESKGYLNIRTDKLIILPKYSLFELENGRRRLLASAGELQKGNELALPTQFMKFLYLASRYNESKGKPEEIEKKQEFVNQHVSYFDDIFQIINDFSKRVILADANLEKINRLYQDNKENIPVDELANNIINLFTFTSLGAPAAFKFFDKIVDRKRYTSTKEVLNSTLIHQSITGLYETRIDLGKLGED

SEQ ID NO: 45 - protein, 1365 aa, Streptococcus agalactiae
MNKPYSIGLDIGTNSVGWSIITDDYKVPAKKMRVLGNTDKEYIKKNLIGALLFDGGNTAADRRLKRTARRRYTRRRNRILYLQEIFAEEMSKVDDSFFHRLEDSFLVEEDKRGSKYPIFATLQEEKDYHEKFPTIYHLRKELADKQEKADLRLIYLALAHIIKFRGHFLIEDDRFDVRNTDIQKQYQAFLEIFDTTFENNHLLSQNVDVEAILTDKISKSAKKDRILAQYPNQKSTGIFAEFLKLIVGNQADFKKHFNLEDKTPLQFAKDSYDEDLENLLGQIGDEFADLFSAAKKLYDSVLLSGILTVIDLSTKAPLSASMIQRYDEHREDLKQLKQFVKASLPEKYQEIFADSSKDGYAGYIEGKTNQEAFYKYLSKLLTKQEDSENFLEKIKNEDFLRKQRTFDNGSIPHQVHLTELKAIIRRQSEYYPFLKENQDRIEKILTFRIPYYIGPLAREKSDFAWMTRKTDDSIRPWNFEDLVDKEKSAEAFIHRMTNNDFYLPEEKVLPKHSLIYEKFTVYNELTKVRYKNEQGETYFFDSNIKQEIFDGVFKEHRKVSKKKLLDFLAKEYEEFRIVDVIGLDKENKAFNASLGTYHDLEKILDKDFLDNPDNESILEDIVQTLTLFEDREMIKKRLENYKDLFTESQLKKLYRRHYTGWGRLSAKLINGIRDKESQKTILDYLIDDGRSNRNFMQLINDDGLSFKSIISKAQAGSHSDNLKEVVGELAGSPAIKKGILQSLKIVDELVKVMGYEPEQIVVEMARENQTTNQGRRNSRQRYKLLDDGVKNLASNILKEYPTDNQALQNERLFLYYLQNGRDMYTGEALDIDNLSQYDIDHIIPQAFIKDDSIDNRVLVSSAKNRGKSDDVPSLEIVKDCKVFWKKLLDAKLMSQRKYDNLTKAERGGLTSDDKARFIQRQLVETRQITKHVARILDERFNNELDSKGRRIRKVKIVTLKSNLVSNFRKEFGFYKIREVNDYHHAHDAYLNAVVAKAILTKYPQLEPEFVYGLYRRKKLSKIVRATRKMFFYSNLMNMFKRVVRLADGSIVVRPVIETGRYMGKTAWDKKKHFATVRKVLSYPQVNIVKKTEIQTGGFSKESILAHGNSDKLIPRKTKDIYLDPKKYGGFDSPIVAYSVLVVADIKKGKAQKLKTVTELLGITIMERSKFEKNPSAFLESKGYLNIRDDKLMILPKYSLFELENGRRRLLASAGELQKGNELALPTQFMKFLYLASRYNESKGKPEEIEKKQEFVNQHVSYFDDILQLINDFSKRVILADANLEKINKLYQDNKENISVDELANNIINLFTFTSLGAPAAFKFFDKIVDRKRYTSTKEVLNSTLIHQSITGLYETRIDLSKLGED

SEQ ID NO: 46 - protein, 1365 aa, Streptococcus agalactiae
MNKPYSIGLDIGTNSVGWSIITDDYKVPAKKMRVLGNTDKEYIKKNLIGALLFDGGNTAADRRLKRTARRRYTRRRNRILYLQEIFAEEMSKVDDSFFHRLEDSFLVEEDKRGSKYPIFATLQEEKDYHEKFSTIYHLRKELADKKEKADLRLIYIALAHIIKFRGHFLIEDDSFDVRNTDISKQYQDFLEIFNITFENNDLLSQNVDVEAILTDKISKSAKKDRILAQYPNQKSTGIFAEFLKLIVGNQADFKKYFNLEDKTPLQFAKDSYDEDLENLLGQIGDEFADLFSAAKKLYDSVLLSGILTVIDLSTKAPLSASMIQRYDEHREDLKQLKQFVKASLPEKYQEIFADSSKDGYAGYIEGKTNQEAFYKYLSKLLTKQEDSENFLEKIKNEDFLRKQRTFDNGSIPHQVHLTELKAIIRRQSEYYPFLKENQDRIEKILTFRIPYYIGPLAREKSDFAWMTRKTDDSIRPWNFEDLVDKEKSAEAFIHRMTNNDFYLPEEKVLPKHSLIYEKFTVYNELTKVRYKNEQGETYFFDSNIKQEIFDGVFKEHRKVSKKKLLDFLAKEYEEFRIVDVIGLDKENKAFNASLGTYHDLEKILDKDFLDNPDNESILEDIVQTLTLFEDREMIKKRLENYKDLFTESQLKKLYRRHYTGWGRLSAKLINGIRDKESQKTILDYLIDDGRSNRNFMQLINDDGLSFKSIISKAQAGSHSDNLKEVVGELAGSPAIKKGILQSLKIVDELVKVMGYEPEQIVVEMARENQTTNQGRRNSRQRYKLLDDGVKNLASNILKEYPTDNQALQNERLFLYYLQNGRDMYTGEALDIDNLSQYDIDHIIPQAFIKDDSIDNRVLVSSAKNRGKSDDVPSLEIVKDCKVFWKKLLDAKLMSQRKYDNLTKAERGGLTSDDKARFIQRQLVETRQITKHVARILDERFNNELDSKGRRIRKVKIVTLKSNLVSNFRKEFGFYKIREVNNYHHAHDAYLNAVVAKAILTKYPQLEPEFVYGDYPKYNSYKTRKATEKLFFYSNIMNFFKTKVTLADGTVVVKDDIEVNNDTGEIVWDKKKHFATVRKVLSYPQNNIVKKTEIQTGGFSKESILAHGNSDKLIPRKTKDIYLDPKKYGGFDSPIVAYSVLVVADIKKGKAQKLKTVTELLGITIMERSRFEKNPSAFLESKGYLNIRADKLIILPKYSLFELENGRRRLLASAGELQKGNELALPTQFMKFLYLASRYNESKGKPEEIEKKQEFVNQHVSYFDDILQLINDFSKRVILADANLEKINKLYQDNKENISVDELANNIINLFTFTSLGAPAAFKFFDKIVDRKRYTSTKEVLNSTLIHQSITGLYETRIDLGKLGED

SEQ ID NO: 47 - protein, 1369 aa, Streptococcus agalactiae
MNKPYSIGLDIGTNSVGWSIITDDYKVPAKKMRVLGNTDKEYIKKNLIGALLFDGGNTAADRRLKRTARRRYTRRRNRILYLQEIFAEEMSKVDDSFFHRLEDSFLVEEDKRGSKYPIFATLQEEKDYHEKFSTIYHLRKELADKKEKADLRLIYIALAHIIKFRGHFLIEDDSFDVRNTDISKQYQDFLEIFNTIFENNDLLSQNVDVEAILTDKISKSAKKDRILAQYPNQKSTGIFAEFLKLIVGNQADFKKYFNLEDKTPLQFAKDSYDEDLENLLGQIGDEFADLFSAAKKLYDSVLLSGILTVIDLSTKAPLSASMIQRYDEHREDLKQLKQFVKASLPEKYQEIFADSSKDGYAGYIEGKTNQEAFYKYLSKLLTKQEDSENFLEKIKNEDFLRKQRTFDNGSIPHQVHLTELKAIIRRQSEYYPFLKENQDRIEKILTFRIPYYIGPLAREKSDFAWMTRKTDDSIRPWNFEDLVDKEKSAEAFIHRMTNNDFYLPEEKVLPKHSLIYEKFTVYNELTKVRYKNEQGETYFFDSNIKQEIFDGVFKEHRKVSKKKLLDFLAKEYEEFRIVDVIGLDKENKAFNASLGTYHDLEKILDKDFLDNPDNESILEDIVQTLTLFEDREMIKKRLENYKDLFTESQLKKLYRRHYTGWGRLSAKLINGIRDKESQKTILDYLIDDGRSNRNFMQLINDDGLSFKSIISKAQAGSHSDNLKEVVGELAGSPAIKKGILQSLKIVDELVKVMGYEPEQIVVEMARENQTTNQGRRNSRQRYKLLDDGVKNLASNILKEYPTDNQALQNERLFLYYLQNGRDMYTGEALDIDNLSQYDIDHIIPQAFIKDDSIDNRVLVSSAKNRGKSDDVPSLEIVKDCKVFWKKLLDAKLMSQRKYDNLTKAERGGLTSDDKARFIQRQLVETRQITKHVARILDERFNNELDSKGRRIRKVKIVTLKSNLVSNFRKEFGFYKIREVNNYHHAHDAYLNAVVAKAILTKYPQLEPEFVYGDYPKYNSYKTRKATEKLFFYSNIMNFFKTKVTLADGTVVVKDDIEVNNDTGEIVWDKKKHFATVRKVLSYPQNNIVKKTEIQTGGFSKESILAHGNSDKLIPRKTKDIYLDPKKYGGFDSPIVAYSVLVVADIKKGKAQKLKTVTELLGITIMERSRFEKNPSAFLESKGYLNIRADKLIILPKYSLFELENGRRRLLASAGETIDRLQKGNELALPTQFMKFLYLASRYNESKGKPEEIEKKQEFVNQHVSYFDDILQLINDFSKRVILADANLEKINKLYQDNKENISVDELANNIINLFTFTSLGAPAAFKFFDKIVDRKRYTSTKEVLNSTLIHQSITGLYETRIDLGKLGED

SEQ ID NO: 48 - protein, 1363 aa, Streptococcus agalactiae
MNKPYSIGLDIGTNSVGWSIITDDYKVPAKKMRVLGNTDKEYIKKNLIGALLFDGGNTAADRRLKRTARRRYTRRRNRILYLQEIFAEEMSKVDDSFFHRLEDSFLVEEDKRGSKYPIFATLQEEKDYHEKFSTIYHLRKELADKKEKADLRLIYIALAHIIKFRGHFLIEDDSFDVRNTDISKQYQDFLEIFNTTFENNDLLSQNVDVEAILTDKISKSAKKDRILAQYPNQKSTGIFAEFLKLIVGNQADFKKYFNLEDKTPLQFAKDSYDEDLENLLGQIGDEFADLFSAAKKLYDSVLLSGILTVIDLSTKAPLSASMIQRYDEHREDLKQLKQFVKASLPEKYQEIFADSSKDGYAGYIEGKTNQEAFYKYLSKLLTKQEDSENFLEKIKNEDFLRKQRTFDNGSIPHQVHLTELKAIIRRQSEYYPFLKENQDRIEKILTFRIPYYIGPLAREKSDFAWMTRKTDDSIRPWNFEDLVDKEKSAEAFIHRMTNNDFYLPEEKVLPKHSLIYEKFTVYNELTKVRYKNEQGETYFFDSNIKQEIFDGVFKEHRKVSKKKLLDFLAKEYEEFRIVDVIGLDKENKAFNASLGTYHDLEKILDKDFLDNPDNESILEDIIQTLTLFEDREMIKKRLENYKDLFTESQLKKLYRRHYTGWGRLSAKLINGIRDKESQKTILDYLIDDGRSNRNFMQLINDDGLSFKSIISKAQAGSHSDNLKEVVGELAGSPAIKKGILQSLKIVDELVKVMGYEPEQIVVEMARENQTTNQGRRNSRQRYKLLDDGVKNLASNILKEYPTDNQALQNERLFLYYLQNGRDMYTGEALDIDNLSQYDIDHIIPQAFIKDDSIDNRVLVSSAKNRGKSDDVPSLEIVKDCKVFWKKLLDAKLMSQRKYDNLTKAERGGLTSKARFIQRQLVETRQITKHVARILDERFNNELDSKGRRIRKVKIVTLKSNLVSNFRKEFGFYKIREVNNYHHAHDAYLNAVVAKAILTKYPQLEPEFVYGDYPKYNSYKTRKATEKLFFYSNIMNFFKTKVTLADGTVVVKDDIEVNNDTGEIVWDKKKHFATVRKVLSYPQNNIVKKTEIQTGGFSKESILAHGNSDKLIPRKTKDIYLDPKKYGGFDSPIVAYSVLVVADIKKGKAQKLKTVTELLGITIMERSRFEKNPSAFLESKGYLNIRADKLIILPKYSLFELENGRRRLLASAGELQKGNELALPTQFMKFLYLASRYNESKGKPEEIEKKQEFVNQHVSYFDDILQLINDFSKRVILADANLEKINKLYQDNKENISVDELANNIINLFTFTSLGAPAAFKFFDKIVDRKRYTSTKEVLNSTLIHQSITGLYETRIDLGKLGED

SEQ ID NO: 49 - protein, 1365 aa, Streptococcus agalactiae
MNKPYSIGLDIGTNSVGWSIITDDYKVPAKKMRVLGNTDKEYIKKNLIGALLFDGGNTAADRRLKRTARRRYTRRRNRILYLQEIFAEEMSKVDDSFFHRLEDSFLVEEDKRGSKYPIFATLQEEKDYHEKFSTIYHLRKELADKKEKADLRLIYIALAHIIKFRGHFLIEDDSFDVRNTDISKQYQDFLEIFNTTFENNDLLSQNVDVEAILTDKISKSAKKDRILAQYPNQKSTGIFAEFLKLIVGNQADFKKYFNLEDKTPLQFAKDSYDEDLENLLGQIGDEFADLFSAAKKLYDSVLLSGILTVIDLSTKAPLSASMIQRYDEHREDLKQLKQFVKASLPEKYQEIFADSSKDGYAGYIEGKTNQEAFYKYLSKLLTKQEDSENFLEKIKNEDFLRKQRTFDNGSIPHQVHLTELKAIIRRQSEYYPFLKENQDRIEKILTFRIPYYIGPLAREKSDFAWMTRKTDDSIRPWNFEDLVDKEKSAEAFIHRMTNNDFYLPEEKVLPKHSLIYEKFTVYNELTKVRYKNEQGETYFFDSNIKQEIFDGVFKEHRKVSKKKLLDFLAKEYEEFRIVDVIGLDKENKAFNASLGTYHDLEKILDKDFLDNPDNESILEDIVQTLTLFEDREMIKKRLENYKDLFTESQLKKLYRRHYTGWGRLSAKLINGIRDKESQKTILDYLIDDGRSNRNFMQLINDDGLSFKSIISKAQAGSHSDNLKEVVGELAGSPAIKKGILQSLKIVDELVKVMGYEPEQIVVEMARENQTTNQGRRNSRQRYKLLDDGVKNLASNILKEYPTDNQALQNERLFLYYLQNGRDMYTGEALDIDDLSQYDIDHIIPQAFIKDDSIDNRVLVSSAKNRGKSDDVPSLEIVKDCKVFWKKLLDAKLMSQRKYDNLTKAERGGLTSDDKARFIQRQLVETRQITKHVARILDERFNNELDSKGRRIRKVKIVTLKSNLVSNFRKEFGFYKIREVNNYHHAHDAYLNAVVAKAILTKYPQLEPEFVYGDYPKYNSYKTRKATEKLFFYSNIMNFFKTKVTLADGTVVVKDDIEVNNDTGEIVWDKKKHFATVRKVLSYPQNNIVKKTEIQTGGFSKESILAHGNSDKLIPRKTKDIYLDPKKYGGFDSPIVAYSVLVVADIKKGKAQKLKTVTELLGITIMERSRFEKNPSAFLESKGYLNIRADKLIILPKYSLFELENGRRRLLASAGELQKGNELALPTQFMKFLYLASRYNESKGKPEEIEKKQEFVNQHVSYFDDILQLINDFSKRVILADANLEKINKLYQDNKENISVDELANNIINLFTFTSLGAPAAFKFFDKIVDRKRYTSTKEVLNSTLIHQSITGLYETRIDLGKLGED

SEQ ID NO: 50 - protein, 1365 aa, Streptococcus agalactiae
MNKPYSIGLDIGTNSVGWSIITDDYKVPAKKMRVLGNTDKEYIKKNLIGALLFDGGNTAADRRLKRTARRRYTRRRNRILYLQEIFAEEMSKVDDSFFHRLEDSFLVEEDKRGSKYPIFATLQEEKDYHEKFSTIYHLRKELADKKEKADLRLIYIALAHIIKFRGHFLIEDDSFDVRNTDISKQYQDFLEIFNTTFENNDLLSQNVDVEAILTDKISKSAKKDRILAQYPNQKSTGIFAEFLKLIVGNQADFKKYFNLEDKTPLQFAKDSYDEDLENLLGQIGDEFADLFSAAKKLYDSVLLSGILTVIDLSTKAPLSASMIQRYDEHREDLKQLKQFVKASLPEKYQEIFADSSKDGYAGYIEGKTNQEAFYKYLSKLLTKQEDSENFLEKIKNEDFLRKQRTFDNGSIPHQVHLTELKAIIRRQSEYYPFLKENQDRIEKILTFRIPYYIGPLAREKSDFAWMTRKTDDSIRPWNFEDLVDKEKSAEAFIHRMTNNDFYLPEEKVLPKHSLIYEKFTVYNELTKVRYKNEQGETYFFDSNIKQEIFDGVFKEHRKVSKKKLLDFLAKEYEEFRIVDVIGLDKENKAFNASLGTYHDLEKILDKDFLDNPDNESILEDIVQTLTLFEDREMIKKRLENYKDLFTESQLKKLYRRHYTGWGRLSAKLINGIRDKESQKTILDYLIDDGRSNRNFMQLINDDGLSFKSIISKAQAGSHSDNLKEVVGELAGSPAIKKGILQSLKIVDELVKVMGYEPEQIVVEMARENQTTNQGRRNSRQRYKLLDDGVKNLASNILKEYPTDNQALQNERLFLYYLQNGRDMYTGEALDIDNLSQYDIDHIIPQAFIKDDSIDNRVLVSSAKNRGKSDDVPSLEIVKDCKVFWKKLLDAKLMSQRKYDNLTKAERGGLTSDDKARFIQRQLVETRQITKHVARILDERFNNELDSKGRRIRKVKIVTLKSNLVSNFRKEFGFYKIREVNNYHHAHDAYLNAVVAKAILTKYPQLEPEFVYGDYPKYNSYKTRKATEKLFFYSNIMNFFKTKVTLADGTVVVKDDIEVNNDTGEIVWDKKKHFATVRKVLSYPQNNIVKKTEIQTGGFSKESILAHGNSDKLIPRKTKDIYLDPKKYGGFDSPIVAYSVLVVADIKKGKAQKLKTVTELLGITIMERSRFEKNPSAFLESKGYLNIRADKLIILPKYSLFELENGRRRLLASAGELQKGNELALPTQFMKFLYLASRYNESKGKPEEIEKKQEFVNQHVSYFDDILQLINDFSKRVILADANLEKINKLYQDNKENISVDELANNIINLFTFTSLGAPAAFKFFDKIVDRKRYTSTKEVLNSTLIHQSITGLYETRIDLGKLGED

SEQ ID NO: 51 - protein, 1365 aa, Streptococcus agalactiae
MNKPYSIGLDIGTNSVGWSIITDDYKVPAKKMRVLGNTDKEYIKKNLIGALLFDGGNTAADRRLKRTARRRYTRRRNRILYLQEIFAEEMSKVDDSFFHRLEDSFLVEEDKRGSKYPIFATLQEEKDYHEKFSTIYHLRKELADKKEKADLRLIYIALAHIIKFRGHFLIEDDSFDVRNTDISKQYQDFLEIFNTTFENNDLLSQNVDVEAILTDKISKSAKKDRILAQYPNQKSTGIFAEFLKLIVGNQADFKKYFNLEDKTPLQFAKDSYDEDLENLLGQIGDEFADLFSAAKKLYDSVLLSGILTVIDLSTKAPLSASMIQRYDEHREDLKQLKQFVKASLPEKYQEIFADSSKDGYAGYIEGKTNQEAFYKYLSKLLTKQEDSENFLEKIKNEDFLRKQRTFDNGSIPHQVHLTELKAIIRRQSEYYPFLKENQDRIEKILTFRIPYYIGPLAREKSDFAWMTRKTDDSIRPWNFEDLVDKEKSAEAFIHRMTNNDFYLPEEKVLPKHSLIYEKFTVYNELTKVRYKNEQGETYFFDSNIKQEIFDGVFKEHRKVSKKKLLDFLAKEYEEFRIVDVIGLDKENKAFNASLGTYHDLEKILDKDFLDNPDNESILEDIVQTLTLFEDREMIKKRLENYKDLFTESQLKKLYRRHYTGWGRLSAKLINGIRDKESQKTILDYLIDDGRSNRNFMQLINDDGLSFKSIISKAQAGSHSDNLKEVVGELAGSPAIKKGILQSLKIVDELVKVMGYEPEQIVVEMARENQTTNQGRRNSRQRYKLLDDGVKNLASNILKEYPTDNQALQNERLFLYYLQNGRDMYTGEALDIDNLSQYDIDHIIPQAFIKDDSIDNRVLVSSAKNRGKSDDVPSLEIVKDCKVFWKKLLDAKLMSQRKYDNLTKAERGGLTSDDKARFIQRQLVETRQITKHVARILDERFNNELDSKGRRIRKVKIVTLKSNLVSNFRKEFGFYKIREVNNYHHAHDAYLNAVVAKAILTKYPQLEPEFVYGDYPKYNSYKTRKATEKLFFYSNIMNFFKTKVTLADGTVVVKDDIEVNNDTGEIVWDKKKHFATVRKVLSYPQNNIVKKTEIQTGGFSKESILAHGNSDKLIPRKTKDIYLDPKKYGGFDSPIVAYSVLVVADIKKGKAQKLKTVTELLGITIMERSRFEKNPSAFLESKGYLNIRADKLIILPKYSLFELENGRRRLLASAGELQKGNELALPTQFMKFLYLASRYNESKGKPEEIEKKQEFVNQHVSYFDDILQLINDFSKRVILADANLEKINKLYQDNKENISVDELANNIINLFTFTSLGAPAAFKFFDKIVDRKRYTSTKEVLNSTLIHQSITGLYETRIDLGKLGGD

SEQ ID NO: 52 - protein, 1365 aa, Streptococcus agalactiae
MNKPYSIGLDIGTNSVGWSIITDDYKVPAKKMRVLGNTDKEYIKKNLIGALLFDGGNTAADRRLKRTARRRYTRRRNRILYLQEIFAEEMSKVDDSFFHRLEDSFLVEEDKRGSKYPIFATLQEEKDYHEKFSTIYHLRKELADKKEKADLRLIYIALAHIIKFRGHFLIEDDSFDVRNTDISKQYQDFLEIFNTTFENNDLLSQNVDVEAILTDKISKSAKKDRILAQYPNQKSTGIFAEFLKLIVGNQADFKKYFNLEDKTPLQFAKDSYDEDLENLLGQIGDEFADLFSAAKKLYDSVLLSGILTVIDLSTKAPLSASMIQRYDEHREDLKQLKQFVKASLPEKYQEIFADSSKDGYAGYIEGKTNQEAFYKYLSKLLTKQEDSENFLEKIKNEDFLRKQRTFDNGSIPHQVHLTELKAIIRRQSEYYPFLKENQDRIEKILTFRIPYYIGPLAREKSDFAWMTRKTDDSIRPWNFEDLVDKEKSAEAFIHRMTNNDFYLPEEKVLPKHSLIYEKFTVYNELTKVRYKNEQGETYFFDSNIKQEIFDGVFKEHRKVSKKKLLDFLAKEYEEFRIVDVIGLDKENKAFNASLGTYHDLEKILDKDFLDNPDNESILEDIVQTLTLFEDREMIKKRLENYKDLFTESQLKKLYRRHYTGWGRLSAKLINGIRDKESQKTILDYLIDDGRSNRNFMQLINDDGLSFKSIISKAQAGSHSDNLKEVVGELAGSPAIKKGILQSLKIVDELVKVMGYEPEQIVVEMARENQTTNQGRRNSRQRYKLLDDGVKNLASNILKEYPTDNQALQNERLFLYYLQNGRDMYTGEALDIDNLSQYDIDHIIPQAFIKDDSIDNRVLVSSAKNRGKSDDVPSLEIVKDCKVFWKKLLDAKLMSQRKYDNLTKAERGGLTSDDKARFIQRQLVETRQITKHVARILDERFNNELDSKGRRIRKVKIVTLKSNLVSNFRKEFGFYKIREVNNYHHAHDAYLNAVVAKAILTKYPQLEPEFVYGDYPKYNSYKTRKATEKLFFYSNIMNFFKTKVTLADGTVVVKDDIEVNNDTGEIVWDKKKHFATVRKVLSYPQNNIVKKTEIQTGGFSKESILAHGNSDKLIPRKTKDIYLDPKKYGGFDSPIVAYSVLVVADIKKGKAQKLKTVTELLGITIMERSRFEKNPSAFLESKGYLNIRDDKLMILPKYSLFELENGRRRLLASAGELQKGNELALPTQFMKFLYLASRYNESKGKPEEIEKKQEFVNQHVSYFDDILQLINDFSKRVILADANLEKINKLYQDNKENISVDELANNIINLFTFTSLGAPAAFKFFDKIVDRKRYTSTKEVLNSTLIHQSITGLYETRIDLGKLGED

SEQ ID NO: 53 - protein, 1365 aa, Streptococcus agalactiae
MNKPYSIGLDIGTNSVGWSIITDDYKVPAKKMRVLGNTDKEYIKKNLIGALLFDGGNTAADRRLKRTARRRYTRRRNRILYLQEIFAEEMSKVDDSFFHRLEDSFLVEEDKRGSKYPIFATLQEEKDYHEKFSTIYHLRKELADKKEKADLRLIYIALAHIIKFRGHFLIEDDSFDVRNTDISKQYQDFLEIFNTTFENNDLLSQNVDVEAILTDKISKSAKKDRILAQYPNQKSTGIFAEFLKLIVGNQADFKKYFNLEDKTPLQFAKDSYDEDLENLLGQIGDEFADLFSAAKKLYDSVLLSGILTVIDLSTKAPLSASMIQRYDEHREDLKQLKQFVKASLPEKYQEIFADSSKDGYAGYIEGKTNQEAFYKYLSKLLTKQEDSENFLEKIKNEDFLRKQRTFDNGSIPHQVHLTELKAIIRRQSEYYPFLKENQDRIEKILTFRIPYYIGPLAREKSDFAWMTRKTDDSIRPWNFEDLVDKEKSAEAFIHRMTNNDFYLPEEKVLPKHSLIYEKFTVYNELTKVRYKNEQGETYFFDSNIKQEIFDGVFKEHRKVSKKKLLDFLAKEYEEFRIVDVIGLDKENKAFNASLGTYHDLEKILDKDFLDNPDNESILEDIVQTLTLFEDREMIKKRLENYKDLFTESQLKKLYRRHYTGWGRLSAKLINGIRDKESQKTILDYLIDDGRSNRNFMQLINDDGLSFKSIISKAQAGSHSDNLKEVVGELAGSPAIKKGILQSLKIVDELVKVVGYEPEQIVVEMARENQTTNQGRRNSRQRYKLLDDGVKNLASNILKEYPTDNQALQNERLFLYYLQNGRDMYTGEALDIDNLSQYDIDHIIPQAFIKDDSIDNRVLVSSAKNRGKSDDVPSLEIVKDCKVFWKKLLDAKLMSQRKYDNLTKAERGGLTSDDKARFIQRQLVETRQITKHVARILDERFNNELDSKGRRIRKVKIVTLKSNLVSNFRKEFGFYKIREVNNYHHAHDAYLNAVVAKAILTKYPQLEPEFVYGDYPKYNSYKTRKATEKLFFYSNIMNFFKTKVTLADGTVVVKDDIEVNNDTGEIVWDKKKHFATVRKVLSYPQNNIVKKTEIQTGGFSKESILAHGNSDKLIPRKTKDIYLDPKKYGGFDSPIVAYSVLVVADIKKGKAQKLKTVTELLGITIMERSRFEKNPSAFLESKGYLNIRADKLIILPKYSLFELENGRRRLLASAGELQKGNELALPTQFMKFLYLASRYNESKGKPEEIEKKQEFVNQHVSYFDDILQLINDFSKRVILADANLEKINKLYQDNKENISVDELANNIINLFTFTSLGAPAAFKFFDKIVDRKRYTSTKEVLNSTLIHQSITGLYETRIDLGKLGED

SEQ ID NO: 54 - protein, 1365 aa, Streptococcus agalactiae
MNKPYSIGLDIGTNSVGWSIITDDYKVPAKKMRVLGNTDKEYIKKNLIGALLFDGGNTAADRRLKRTARRRYTRRRNRILYLQEIFAEEMSKVDDSFFHRLEDSFLVEEDKRGSKYPIFATLQEEKDYHEKFSTIYHLRKELADKKEKADLRLIYIALAHIIKFRGHFLIEDDSFDVRNTDISKQYQDFLEIFNTTFENNDLLSQNVDVEAILTDKISKSAKKDRILAQYPNQKSTGIFAEFLKLIVGNQADFKKYFNLEDKTPLQFAKDSYDEDLENLLRQIGDEFADLFSAAKKLYDSVLLSGILTVIDLSTKAPLSASMIQRYDEHREDLKQLKQFVKASLPEKYQEIFADSSKDGYAGYIEGKTNQEAFYKYLSKLLTKQEDSENFLEKIKNEDFLRKQRTFDNGSIPHQVHLTELKAIIRRQSEYYPFLKENQDRIEKILTFRIPYYIGPLAREKSDFAWMTRKTDDSIRPWNFEDLVDKEKSAEAFIHRMTNNDFYLPEEKVLPKHSLIYEKFTVYNELTKVRYKNEQGETYFFDSNIKQEIFDGVFKEHRKVSKKKLLDFLAKEYEEFRIVDVIGLDKENKAFNASLGTYHDLEKILDKDFLDNPDNESILEDIVQTLTLFEDREMIKKRLENYKDLFTESQLKKLYRRHYTGWGRLSAKLINGIRDKESQKTILDYLIDDGRSNRNFMQLINDDGLSFKSIISKAQAGSHSDNLKEVVGELAGSPAIKKGILQSLKIVDELVKVMGYEPEQIVVEMARENQTTNQGRRNSRQRYKLLDDGVKNLASNILKEYPTDNQALQNERLFLYYLQNGRDMYTGEALDIDNLSQYDIDHIIPQAFIKDDSIDNRVLVSSAKNRGKSDDVPSLEIVKDCKVFWKKLLDAKLMSQRKYDNLTKAERGGLTSDDKARFIQRQLVETRQITKHVARILDERFNNELDSKGRRIRKVKIVTLKSNLVSNFRKEFGFYKIREVNNYHHAHDAYLNAVVAKAILTKYPQLEPEFVYGDYPKYNSYKTRKATEKLFFYSNIMNFFKTKVTLADGTVVVKDDIEVNNDTGEIVWDKKKHFATVRKVLSYPQNNIVKKTEIQTGGFSKESILAHGNSDKLIPRKTKDIYLDPKKYGGFDSPIVAYSVLVVADIKKGKAQKLKTVTELLGITIMERSRFEKNPSAFLESKGYLNIRADKLIILPKYSLFELENGRRRLLASAGELQKGNELALPTQFMKFLYLASRYNESKGKPEEIEKKQEFVNQHVSYFDDILQLINDFSKRVILADANLEKINKLYQDNKENISVDELANNIINLFTFTSLGAPAAFKFFDKIVDRKRYTSTKEVLNSTLIHQSITGLYETRIDLGKLGED

SEQ ID NO: 55 - protein, 1365 aa, Streptococcus agalactiae
MNKPYSIGLDIGTNSVGWSIITDDYKVPAKKMRVLGNTDKEYIKKNLIGALLFDGGNTAADRRLKRTARRRYTRRRNRILYLQEIFAEEMSKVDDSFFHRLEDSFLVEEDKRGSKYPIFATMQEEKDYHEKFPTIYHLRKELADKKEKADLRLVYLALAHIIKFRGHFLIEDDRFDVRNTDIQKQYQAFLEIFDTSFENNHLLSQNVDVEAILTDKISKSAKKDRILAQYPNQKSTGIFAEFLKLIVGNQADFKKHFNLEDKTPLQFAKDSYDEDLENLLGQIGDEFADLFSAAKKLYDSVLLSGILTVTDLSTKAPLSAYMIQRYDEHREDLKQLKQFVKASLPEKYQEIFADSSKDGYAGYIEGKTNQEAFYKYLSKLLTKQEDSEYFLEKIKNEDFLRKQRTFDNGSIPHQVHLTELKAIIRRQSEYYPFLKENQDKIEKILTFRIPYYVGPLARGNSDFAWMTRKTDDSIRPWNFEDLVDKEKSAEAFIHRMTNNDLYLPEEKVLPKHSLIYEKFTVYNELTKVRYKNEQGETYFFDSNVKQEIFDGVFKEHRKVSKKQLLDFLAKEFEEFRIVDVTGLDKENKAFNASLGTYHDLKKILDKDFLDNPDNESILEDIVQTITLFEDREMIKKRLENYKDLFTESQLKKLYRRHYTGWGRLSAKLINGIRDRESQKTILDYLISDGRANRNFMQLINDDGLSFKSIISKAQSGSHSDNLKEVVGELAGSPAIKKGILQSLKIVDELVKVMGYEPEQIVVEMARENQTTNQGRRNSRQRYKLLEDGVKNLASDILKEYPTDNQALQNERLFLYYLQNGRDMYTGEALDIDNLSQYDIDHIVPQAFIKDDSIDNRVLVSSAKNRGKSDDVPSIDIVKARKAFWKKLLDAKLISQRKYDNLTKAERGGLTPDDKAGFIQRQLVETRQITKHVARILDERFNNKVDDNNKPIRKVKIVTLKSNLVSNFRKEFGFYKIREVNNYHHAHDAYLNAVVAKAILTKYPQLEPEFVYGDYPKYNSYKTRKATEKLFFYSNIMNFFKTKVTLADETVVVKDDIEVNNETGEIAWDKKKHFATVRKVLSYPQVNIVKKTEVQTGGFSKESILAHSNSDKLIPRKTKDIYLDPKKYGGFDSPIVAYSVLVLADIKKGKAQKLKTVKELIGITIMERERFEKNPSAFLESKGYLNIRTDKLIILPKYSLFELENGRRRLLASAGELQKGNELALPTQYMKFLYLASRYNESKGKPEEIEKKQEFVNQHISYFDDILQLINDFSKRVILADANLEKINKLYSDNKDNTPVDELAKNIINLFTFTSLGAPAAFKFFDKSVDRKRYTSTKEVLDSTLIHQSITGLYETRIDLGKLGED

SEQ ID NO: 56 - protein, 1365 aa, Streptococcus agalactiae
MNKPYSIGLDIGTNSVGWSIITDDYKVPAKKMRVLGNTDKEYIKKNLIGALLFDGGNTAADRRLKRTARRRYTRRRNRILYLQEIFAEEMSKVDDSFFHRLEDSFLVEEDKRGSKYPIFATMQEEKYYHEKFPTIYHLRKELADKKEKADLRLIYLALAHIIKFRGHFLIEDDRFDVRNTDIQKQYQAFLEIFDTTFENNDLLSQNVDVEAILTDKISKSAKKDRILARYPNQKSTGIFAEFLKLIVGNQADFKKHFNLEDKTPLQFAKDSYDEDLENLLGQIGDEFADLFSAAKKLYDSVLLSGILTVTDLSTKAPLSASMIQHYDEHREDLKQLKQFVKASLPEKYQEIFADSSKDGYAGYIEGKTNQEAFYKYLSKLLTKQEGSEYLLEKIKNEDFLRKQRTFDNGSIPHQVHLTELRAIIRRQSEYYPFLKENLDRIEKILTFRIPYYVGPLAREKSDFAWMTRKTDDSIRPWNFEDLVDKEKSAEAFIHRMTNNDLYLPEEKVLPKHSLIYEKFTVYNELTKVRFLAEGFKDFQFLNRKQKETIFNSLFKEKRKVTEKDIISFLNKVDGYEGIAIKGIEKQFNASLSTYHDLKKILGKDFLDNTDNELILEDIVQTLTLFEDREMIRKRLDIYKDFFTESQLKKLYRRHYTGWGRLSAKLINGIRNKENQKTILDYLIDDGSANRNFMQLIKDAGLSFKPIIDKARTGSHSDNLKEVVGELAGSPAIKKGILQSLKIVDELVKVMGYEPEQIVVEMARENQTTAKGLSRSRQRLTTLRESLANLKSEKKPKYVKDQVENHHLSDDRLFLYYLQNGKDMYTDDELDIDNLSQYDIDHIIPQAFIKDDSIDNRVLVSSAKNRGKSDDVPSVEIVKDCKVFWKKLLDAKLMSQRKYDNLTKAERGGLTSDDKARFIQRQLVETRQITKHVARILDERFNNELDSKGRRIRKVKIVTLKSNLVSNFRKEFGFYKIREVNNYHHAHDAYLNAVVAKAILTKYPQLEPEFVYGDYPKYNSYKTRKATEKLFFYSNIMNFFKTKVTLADGTVVVKDDIEVNNDTGEIVWDKKKHFATVRKVLSYPQVNIVKKTEIQTGGFSKESILAHGNSDKLIPRKTKDIYLDPKKYGGFDSPIVAYSVLVVADIKKGKAQKLKTVTELLGITIMERSRFEKNPSAFLESKGYLNIRDDKLMILPKYSLFELENGRRRLLASAGELQKGNELALPTQFMKFLYLASRYNELKGKPEEIEQKQEFVVQHVSYFDDILQIINDFSNRVILADANLEKINKLYQDNKENIPVDELANNIINLFTFTSLGAPAAFKFFDKIVDRKRYTSTKEVLNSTLIHQSITGLYETRIDLGKLGED

SEQ ID NO: 57 - protein, 1365 aa, Streptococcus agalactiae
MNKPYSIGLDIGTNSVGWSIITDDYKVPAKKMRVLGNTDKEYIKKNLIGALLFDGGNTAADRRLKRTARRRYTRRRNRILYLQEIFAEEMSKVDDSFFHRLEDSFLVEEDKRGSKYPIFATMQEEKYYHEKFPTIYHLRKELADKKEKADLRLIYLALAHIIKFRGHFLIEDDRFDVRNTDIQKQYQAFLEIFDTTFENNDLLSQNVDVEAILTDKISKSAKKDRILARYPNQKSTGIFAEFLKLIVGNQADFKKHFNLEDKTPLQFAKDSYDEDLENLLGQIGDEFADLFSAAKKLYDSVLLSGILTVTDLSTKAPLSASMIQRYDEHREDLKQLKQFVKASLPEKYQEIFADSSKDGYAGYIEGKTNQEAFYKYLSKLLTKQEGSEYLLEKIKNEDFLRKQRTFDNGSIPHQVHLTELRAIIRRQSEYYPFLKENLDRIEKILTFRIPYYVGPLAREKSDFAWMTRKTDDSIRPWNFEDLVDKEKSAEAFIHRMTNNDLYLPEEKVLPKHSLIYEKFTVYNELTKVRFLAEGFKDFQFLNRKQKETIFNSLFKEKRKVTEKDIISFLNKVDGYEGIAIKGIEKQFNASLSTYHDLKKILGKDFLDNTDNELILEDIVQTLTLFEDREMIRKRLDIYKDFFTESQLKKLYRRHYTGWERLSAKLINGIRNKENQKTILDYLIDDGSANRNFMQLIKDAGLSFKPIIDKARTGSHLDNLKEVVGELAGSPAIKKGILQSLKIVDELVKVMGYEPEQIVVEMARENQTTAKGLSRSRQRLTTLRESLANLKSEKKPKYVKDQVENHHLSDDRLFLYYLQNGKDMYTDDELDIDNLSQYDIDHIIPQAFIKDDSIDNRVLVSSAKNRGKSDDVPSLEIVKDCKVFWKKLLDAKLMSQRKYDNLTKAERGGLTSDDKARFIQRQLVETRQITKHVARILDERFNNELDSKGRRIRKVKIVTLKSNLVSNFRKEFGFYKIREVNNYHHAHDAYLNAVVAKAILTKYPQLEPEFVYGDYPKYNSYKTRKATEKLFFYSNIMNFFKTKVTLADGTVVVKDDIEVNNDTGEIVWDKKKHFATVRKVLSYPQVNIVKKTEVQTGGFSKESILAHGNSDKLIPRKTKDIYLDPKKYGGFDSPIVAYSVLVVADIKKGKAQKLKTVTELLGITIMERSRFEKNPSAFLESKGYLNIRTDKLIILPKYSLFELENGRRRLLASAGELQKGNELALPTQYMKFLYLASRYNELKGKPEEIEQKQEFVVQHVSYFDDILQIINDFSNRVILADANLEKINKLYQDNKENIPVDELANNIINLFTFTSLGAPAAFKFFDKIVDRKRYTSTKEVLNSTLIHQSITGLYETRIDLGKLGEG

SEQ ID NO: 58 - protein, 1365 aa, Streptococcus agalactiae
MNKPYSIGLDIGTNSVGWSIITDDYKVPAKKMRVLGNTDKEYIKKNLIGALLFDGGNTAADRRLKRTARRRYTRRRNRILYLQEIFAEEMSKVDDSFFHRLEDSFLVEEDKRGSKYPIFATMQEEKYYHEKFPTIYHLRKELADKKEKADLRLIYLALAHIIKFRGHFLIEDDRFDVRNTDIQKQYQAFLEIFDTTFENNDLLSQNVDVEAILTDKISKSAKKDRILARYPNQKSTGIFAEFLKLIVGNQADFKKHFNLEDKTPLQFAKDSYDEDLENLLGQIGDEFADLFSAAKKLYDSVLLSGILTVTDLSTKAPLSASMIQRYDEHREDLKQLKQFVKASLPEKYQEIFADSSKDGYAGYIEGKTNQEAFYKYLSKLLTKQEGSEYLLEKIKNEDFLRKQRTFDNGSIPHQVHLTELRAIIRRQSEYYPFLKENLDRIEKILTFRIPYYVGPLAREKSDFAWMTRKTDDSIRPWNFEDLVDKEKSAEAFIHRMTNNDLYLPEEKVLPKHSLIYEKFTVYNELTKVRFLAEGFKDFQFLNRKQKETIFNSLFKEKRKVTEKDIISFLNKVDGYEGIAIKGIEKQFNASLSTYHDLKKILGKDFLDNTDNELILEDIVQTLTLFEDREMIRKRLDIYKDFFTESQLKKLYRRHYTGWGRLSAKLINGIRNKENQKTILDYLIDDGSANRNFMQLIKDAGLSFKPIIDKARTGSHLDNLKEVVGELAGSPAIKKGILQSLKIVDELVKVMGYEPEQIVVEMARENQTTAKGLSRSRQRLTTLRESLANLKSEKKPKYVKDQVENHHLSDDRLFLYYLQNGKDMYTDDELDIDNLSQYDIDHIIPQAFIKDDSIDNRVLVSSAKNRGKSDDVPSLEIVKDCKVFWKKLLDAKLMSQRKYDNLTKAERGGLTSDDKARFIQRQLVETRQITKHVARILDERFNNELDSKGRRIRKVKIVTLKSNLVSNFRKEFGFYKIREVNNYHHAHDAYLNAVVAKAILTKYPQLEPEFVYGDYPKYNSYKTRKATEKLFFYSNIMNFFKTKVTLADGTVVVKDDIEVNNDTGEIVWDKKKHFATVRKVLSYPQVNIVKKTEVQTGGFSKESILAHGNSDKLIPRKTKDIYLDPKKYGGFDSPIVAYSVLVVADIKKGKAQKLKTVTELLGITIMERSRFEKNPSAFLESKGYLNIRTDKLIILPKYSLFELENGRRRLLASAGELQKGNELALPTQYMKFLYLASRYNELKGKPEEIEQKQEFVVQHVSYFDDILQIINDFSNRVILADANLEKINKLYQDNKENIPVDELANNIINLFTFTSLGAPAAFKFFDKIVDRKRYTSTKEVLNSTLIHQSITGLYETRIDLGKLGEG

SEQ ID NO: 59 - protein, 1365 aa, Streptococcus agalactiae
MNKPYSIGLDIGTNSVGWSIITDDYKVPAKKMRVLGNTDKEYIKKNLIGALLFDGGNTAADRRLKRTARRRYTRRRNRILYLQEIFAEEMSKVDDSFFHRLEDSFLVEEDKRGSKYPIFATMQEEKYYHEKFPTIYHLRKELADKKEKADLRLIYLALAHIIKFRGHFLIEDDRFDVRNTDIQKQYQAFLEIFDTTFENNDLLSQNVDVEAILTDKISKSAKKDRILARYPNQKSTGIFAEFLKLIVGNQADFKKHFNLEDKTPLQFAKDSYDEDLENLLGQIGDEFADLFSAAKKLYDSVLLSGILTVTDLSTKAPLSASMIQRYDEHREDLKQLKQFVKASLPEKYQEIFADSSKDGYAGYIEGKTNQEAFYKYLSKLLTKQEGSEYLLEKIKNEDFLRKQRTFDNGSIPHQVHLTELRAIIRRQSEYYPFLKENLDRIEKILTFRIPYYVGPLAREKSDFAWMTRKTDDSIRPWNFEDLVDKEKSAEAFIHRMTNNDLYLPEEKVLPKHSLIYEKFTVYNELTKVRFLAEGFKDFQFLNRKQKETIFNSLFKEKRKVTEKDIISFLNKVDGYEGIAIKGIEKQFNASLSTYHDLKKILGKDFLDNTDNELILEDIVQTLTLFEDREMIRKRLDIYKDFFTESQLKKLYRRHYTGWGRLSAKLINGIRNKENQKTILDYLIDDGSANRNFMQLIKDAGLSFKPIIDKARTGSHSDNLKEVVGELAGSPAIKKGILQSLKIVDELVKVMGYEPEQIVVEMARENQTTAKGLSRLRQRLTTLRESLANLKSEKKPKYVKDQVENHHLSDDRLFLYYLQNGKDMYTDDELDIDNLSQYDIDHIIPQAFIKDDSIDNRVLVSSAKNRGKSDDVPSVEIVKDCKVFWKKLLDAKLMSQRKYDNLTKAERGGLTSDDKARFIQRQLVETRQITKHVARILDERFNNELDSKGRRIRKVKIVTLKSNLVSNFRKEFGFYKIREVNNYHHAHDAYLNAVVAKAILTKYPQLEPEFVYGDYPKYNSYKTRKATEKLFFYSNIMNFFKTKVTLADGTVVVKDDIEVNNDTGEIVWDKKKHFATVRKVLSYPQVNIVKKTEIQTGGFSKESILAHGNSDKLIPRKTKDIYLDPKKYGGFDSPIVAYSVLVVADIKKGKAQKLKTVTELLGITIMERSRFEKNPSAFLESKGYLNIRDDKLMILPKYSLFELENGRRRLLASADELQKGNELALPTQFMKFLYLASRYNELKGKPEEIEQKQEFVVQHVSYFDDILQIINDFSNRVILADANLEKINKLYQDNKENIPVDELANNIINLFTFTSLGAPAAFKFFDKIVDRKRYTSTKEVLNSTLIHQSITGLYETRIDLGKLGED

SEQ ID NO: 60 - protein, 1365 aa, Streptococcus agalactiae
MNKPYSIGLDIGTNSVGWSIITDDYKVPAKKMRVLGNTDKEYIKKNLIGALLFDGGNTAADRRLKRTARRRYTRRRNRILYLQEIFAEEMSKVDDSFFHRLEDSFLVEEDKRGSKYPIFATMQEEKYYHEKFPTIYHLRKELADKKEKADLRLIYLALAHIIKFRGHFLIEDDRFDVRNTDIQKQYQAFLEIFDTTFENNDLLSQNVDVEAILTDKISKSAKKDRILARYPNQKSTGIFAEFLKLIVGNQADFKKHFNLEDKTPLQFAKDSYDEDLENLLGQIGDEFADLFSAAKKLYDSVLLSGILTVTDLSTKAPLSASMIQRYDEHREDLKQLKQFVKASLPEKYQEIFADSSKDGYAGYIEGKTNQEAFYKYLSKLLTKQEGSEYLLEKIKNEDFLRKQRTFDNGSIPHQVHLTELRAIIRRQSEYYPFLKENLDRIEKILTFRIPYYVGPLAREKSDFAWMTRKTDDSIRPWNFEDLVDKEKSAEAFIHRMTNNDLYLPEEKVLPKHSLIYEKFTVYNELTKVRFLAEGFKDFQFLNRKQKETIFNSLFKEKRKVTEKDIISFLNKVDGYEGIAIKGIEKQFNASLSTYHDLKKILGKDFLDNTDNELILEDIVQTLTLFEDREMIRKRLDIYKDFFTESQLKKLYRRHYTGWGRLSAKLINGIRNKENQKTILDYLIDDGSANRNFMQLIKDAGLSFKPIIDKARTGSHSDNLKEVVGELAGSPAIKKGILQSLKIVDELVKVMGYEPEQIVVEMARENQTTAKGLSRSRQRLTTLRESLANLKSEKKPKYVKDQVENHHLSDDRLFLYYLQNGKDMYTDDELDIDNLSQYDIDHIIPQAFIKDDSIDNRVLVSSAKNRGKSDDVPSVEIVKDCKVFWKKLLDAKLMSQRKYDNLTKAERGGLTSDDKARFIQRQLVETRQITKHVARILDERFNNELDSKGRRIRKVKIVTLKSNLVSNFRKEFGFYKIREVNNYHHAHDAYLNAVVAKAILTKYPQLEPEFVYGDYPKYNSYKTRKATEKLFFYSNIMNFFKTKVTLADGTVVVKDDIEVNNDTGEIVWDKKKHFATVRKVLSYPQVNIVKKTEIQTGGFSKESILAHGNSDKLIPRKTKDIYLDPKKYGGFDSPIVAYSVLVVADIKKGKAQKLKTVTELLGITIMERSRFEKNPSAFLESKGYLNIRDDKLMILPKYSLFELENGRRRLLASAGELQKGNELALPTQFMKFLYLASRYNELKGKPEEIEQKQEFVVQHVSYFDDILQIINDFSNRVILADANLEKINKLYQDNKENIPVDELANNIINLFTFTSLGAPAAFKFFDKIVDRKRYTSTKEVLNSTLIHQSITGLYETRIDLGKLGED

SEQ ID NO: 61 - protein, 1365 aa, Streptococcus agalactiae
MNKPYSIGLDIGTNSVGWSIITDDYKVPAKKMRVLGNTDKEYIKKNLIGALLFDGGNTAADRRLKRTARRRYTRRRNRILYLQEIFAEEMSKVDDSFFHRLEDSFLVEEDKRGSKYPIFATMQEEKYYHEKFPTIYHLRKELADKKEKADLRLIYLALAHIIKFRGHFLIEDDRFDVRNTDIQKQYQAFLEIFDTTFENNDLLSQNVDVEAILTDKISKSAKKDRILARYPNQKSTGIFAEFLKLIVGNQADFKKHFNLEDKTPLQFAKDSYDEDLENLLGQIGDEFADLFSAAKKLYDSVLLSGILTVTDLSTKAPLSASMIQRYDEHREDLKQLKQFVKASLPEKYQEIFADSSKDGYAGYIEGKTNQEAFYKYLSKLLTKQEGSEYLLEKIKNEDFLRKQRTFDNGSIPHQVHLTELRAIIRRQSEYYPFLKENLDRIEKILTFRIPYYVGPLAREKSDFAWMTRKTDDSIRPWNFEDLVDKEKSAEAFIHRMTNNDLYLPEEKVLPKHSLIYEKFTVYNELTKVRFLAEGFKDFQFLNRKQKETIFNSLFKEKRKVTEKDIISFLNKVDGYEGIAIKGIEKQFNASLSTYHDLKKILGKDFLDNTDNELILEDIVQTLTLFEDREMIRKRLDIYKDFFTESQLKKLYRRHYTGWGRLSAKLINGIRNKENQKTILDYLIDDGSANRNFMQLIKDAGLSFKPIIDKARTGSHSDNLKEVVGELAGSPAIKKGILQSLKIVDELVKVMGYEPEQIVVEMARENQTTAKGLSRSRQRLTTLRESLANLKSEKKPKYVKDQVENHHLSDDRLFLYYLQNGKDMYTDDELDIDNLSQYDIDHIIPQAFIKDDSIDNRVLVSSAKNRGKSDDVPSVEIVKDCKVFWKKLLDAKLMSQRKYDNLTKAERGGLTSDDKARFIQRQLVETRQITKHVARILDERFNNELDSKGRRIRKVKIVTLKSNLVSNFRKEFGFYKIREVNNYHHAHDAYLNAVVAKAILTKYPQLEPEFVYGDYPKYNSYKTRKATEKLFFYSNIMNFFKTKVTLADGTVVVKDDIEVNNDTGEIVWDKKKHFATVRKVLSYPQVNIVKKTEIQTGGFSKESILAHGNSDKLIPRKTKDIYLDPKKYGGFDSPKVAYSVLVVADIKKGKAQKLKTVTELLGITIMERSRFEKNPSAFLESKGYLNIRDDKLMILPKYSLFELENGRRRLLASAGELQKGNELALPTQFMKFLYLASRYNELKGKPEEIEQKQEFVVQHVSYFDDILQIINDFSNRVILADANLEKINKLYQDNKENIPVDELANNIINLFTFTSLGAPAAFKFFDKIVDRKRYTSTKEVLNSTLIHKSITGLYETRIDLGKLGED

SEQ ID NO: 62 - protein, 1365 aa, Streptococcus agalactiae
MNKPYSIGLDIGTNSVGWSIITDDYKVPAKKMRVLGNTDKEYIKKNLIGALLFDGGNTAADRRLKRTARRRYTRRRNRILYLQEIFAEEMSKVDDSFFHRLEDSFLVEEDKRGSKYPIFATMQEEKYYHEKFPTIYHLRKELADKKEKADLRLIYLALAHIIKFRGHFLIEDDRFDVRNTDIQKQYQAFLEIFDTTFENNDLLSQNVDVEAILTDKISKSAKKDRILARYPNQKSTGIFAEFLKLIVGNQADFKKHFNLEDKTPLQFAKDSYDEDLENLLGQIGDEFADLFSAAKKLYDSVLLSGILTVTDLSTKAPLSASMIQRYDEHREDLKQLKQFVKASLPEKYQEIFADSSKDGYAGYIEGKTNQEAFYKYLSKLLTKQEGSEYLLEKIKNEDFLRKQRTFDNGSIPHQVHLTELRAIIRRQSEYYPLLKENLDRIEKILTFRIPYYVGPLAREKSDFAWMTRKTDDSIRPWNFEDLVDKEKSAEAFIHRMTNNDLYLPEEKVLPKHSLIYEKFTVYNELTKVRFLAEGFKDFQFLNRKQKETIFNSLFKEKRKVTEKDIISFLNKVDGYEGIAIKGIEKQFNASLSTYHDLKKILGKDFLDNTDNELILEDIVQTLTLFEDREMIRKRLDIYKDFFTESQLKKLYRRHYTGWGRLSAKLINGIRNKENQKTILDYLIDDGSANRNFMQLIKDAGLSFKPIIDKARTGSHSDNLKEVVGELAGSPAIKKGILQSLKIVDELVKVMGYEPEQIVVEMARENQTTAKGLSRSRQRLTTLRESLANLKSEKKPKYVKDQVENHHLSDDRLFLYYLQNGKDMYTDDELDIDNLSQYDIDHIIPQAFIKDDSIDNRVLVSSAKNRGKSDDVPSVEIVKDCKVFWKKLLDAKLMSQRKYDNLTKAERGGLTSDDKARFIQRQLVETRQITKHVARILDERFNNELDSKGRRIRKVKIVTLKSNLVSNFRKEFGFYKIREVNNYHHAHDAYLNAVVAKAILTKYPQLEPEFVYGDYPKYNSYKTRKATEKLFFYSNIMNFFKTKVTLADGTVVVKDDIEVNNDTGEIVWDKKKHFATVRKVLSYPQVNIVKKTEIQTGGFSKESILAHGNSDKLIPRKTKDIYLDPKKYGGFDSPIVAYSVLVVADIKKGKAQKLKTVTELLGITIMERSRFEKNPSAFLESKGYLDIRDDKLMILPKYSLFELENGRRRLLASAGELQKGNELALPTQFMKFLYLASRYNELKGKPEEIEQKQEFVVQHVSYFDDILQIINDFSNRVILADANLEKINKLYQDNKENIPVDELANNIINLFTFTSLGAPAAFKFFDKIVDRKRYTSTKEVLNSTLIHQSITGLYETRIDLGKLGED

SEQ ID NO: 63 - protein, 1365 aa, Streptococcus agalactiae
  misc_feature (117)..(117): Xaa can be any naturally occurring amino acid
MNKPYSIGLDIGTNSVGWSIITDDYKVPAKKMRVLGNTDKEYIKKNLIGALLFDGGNTAADRRLKRTARRRYTRRRNRILYLQEIFAEEMSKVDDSFFHRLEDSFLVEEDKRGSKYXIFATLQEEKDYHEKFSTIYHLRKELADKKEKADLRLIYIALAHIIKFRGHFLIEDDSFDVRNTDISKQYQDFLEIFNTTFENNDLLSQNVDVEAILTDKISKSAKKDRILAQYPNQKSTGIFAEFLKLIVGNQADFKKYFNLEDKTPLQFAKDSYDEDLENLLGQIGDEFADLFSAAKKLYDSVLLSGILTVIDLSTKAPLSASMIQRYDEHREDLKQLKQFVKASLPEKYQEIFADSSKDGYAGYIEGKTNQEAFYKYLSKLLTKQEDSENFLEKIKNEDFLRKQRTFDNGSIPHQVHLTELKAIIRRQSEYYPFLKENQDRIEKILTFRIPYYIGPLAREKSDFAWMTRKTDDSIRPWNFEDLVDKEKSAEAFIHRMTNNDFYLPEEKVLPKHSLIYEKFTVYNELTKVRYKNEQGETYFFDSNIKQEIFDGVFKEHRKVSKKKLLDFLAKEYEEFRIVDVIGLDKENKAFNASLGTYHDLEKILDKDFLDNPDNESILEDIVQTLTLFEDREMIKKRLENYKDLFTESQLKKLYRRHYTGWGRLSAKLINGIRDKESQKTILDYLIDDGRSNRNFMQLINDDGLSFKSIISKAQAGSHSDNLKEVVGELAGSPAIKKGILQSLKIVDELVKVMGYEPEQIVVEMARENQTTNQGRRNSRQRYKLLDDGVKNLASNILKEYPTDNQALQNERLFLYYLQNGRDMYTGEALDIDNLSQYDIDHIIPQAFIKDDSIDNRVLVSSAKNRGKSDDVPSLEIVKDCKVFWKKLLDAKLMSQRKYDNLTKAERGGLTSDDKARFIQRQLVETRQITKHVARILDERFNNELDSKGRRIRKVKIVTLKSNLVSNFRKEFGFYKIREVNNYHHAHDAYLNAVVAKAILTKYPQLEPEFVYGDYPKYNSYKTRKATEKLFFYSNIMNFFKTKVTLADGTVVVKDDIEVNNDTGEIVWDKKKHFATVRKVLSYPQNNIVKKTEIQTGGFSKESILAHGNSDKLIPRKTKDIYLDPKKYGGFDSPIVAYSVLVVADIKKGKAQKLKTVTELLGITIMERSRFEKNPSAFLESKGYLNIRADKLIILPKYSLFELENGRRRLLASAGELQKGNELALPTQFMKFLYLASRYNESKGKPEEIEKKQEFVNQHVSYFDDILQLINDFSKRVILADANLEKINKLYQDNKENISVDELANNIINLFTFTSLGAPAAFKFFDKIVDRKRYTSTKEVLNSTLIHQSITGLYETRIDLGKLGED

SEQ ID NO: 64 - protein, 1365 aa, Streptococcus agalactiae
MNKPYSIGLDIGTNSVGWSIITDDYKVPAKKMRVLGNTDKEYIKKNLIGALLFDGGNTAADRRLKRTSRRRYTRRRNRILYLQEIFAEEMSKVDDSFFHRLEDSFLVEEDKRGSKYPIFATLQEEKDYHEKFSTIYHLRKELADKKEKADLRLIYIALAHIIKFRGHFLIEDDSFDVRNTDISKQYQDFLEIFNTTFENNDLLSQNVDVEAILTDKISKSAKKDRILAQYPNQKSTGIFAEFLKLIVGNQADFKKYFNLEDKTPLQFAKDSYDEDLENLLGQIGDEFADLFSAAKKLYDSVLLSGILTVIDLSTKAPLSASMIQRYDEHREDLKQLKQFVKASLPEKYQEIFADSSKDGYAGYIEGKTNQEAFYKYLSKLLTKQEDSENFLEKIKNEDFLRKQRTFDNGSIPHQVHLTELKAIIRRQSEYYPFLKENQDRIEKILTFRIPYYIGPLAREKSDFAWMTRKTDDSIRPWNFEDLVDKEKSAEAFIHRMTNNDFYLPEEKVLPKHSLIYEKFTVYNELTKVRYKNEQGETYFFDSNIKQEIFDGVFKEHRKVSKKKLLDFLAKEYEEFRIVDVIGLDKENKAFNASLGTYHDLEKILDKDFLDNPDNESILEDIVQTLTLFEDREMIKKRLENYKDLFTESQLKKLYRRHYTGWGRLSAKLINGIRDKESQKTILDYLIDDGRSNRNFMQLINDDGLSFKSIISKAQAGSHSDNLKEVVGELAGSPAIKKGILQSLKIVDELVKVMGYEPEQIVVEMARENQTTNQGRRNSRQRYKLLDDGVKNLASNILKEYPTDNQALQNERLFLYYLQNGRDMYTGEALDIDNLSQYDIDHIIPQAFIKDDSIDNRVLVSSAKNRGKSDDVPSLEIVKDCKVFWKKLLDAKLMSQRKYDNLTKAERGGLTSDDKARFIQRQLVETRQITKHVARILDERFNNELDSKGRRIRKVKIVTLKSNLVSNFRKEFGFYKIREVNNYHHAHDAYLNAVVAKAILTKYPQLEPEFVYGDYPKYNSYKTRKATEKLFFYSNIMNFFKTKVTLADGTVVVKDDIEVNNDTGEIVWDKKKHFATVRKVLSYPQNNIVKKTEIQTGGFSKESILAHGNSDKLIPRKTKDIYLDPKKYGGFDSPIVAYSVLVVADIKKGKAQKLKTVTELLGITIMERSRFEKNPSAFLESKGYLNIRADKLIILPKYSLFELENGRRRLLASAGELQKGNELALPTQFMKFLYLASRYNESKGKPEEIEKKQEFVNQHVSYFDDILQLINDFSKRVILADANLEKINKLYQDNKENISVDELANNIINLFTFTSLGAPAAFKFFDKIVDRKRYTSTKEVLNSTLIHQSITGLYETRIDLGKLGED

SEQ ID NO: 65 - protein, 1365 aa, Streptococcus agalactiae
MNKPYSIGLDIGTNSVGYSVVTDDYKVPAKKMRVLGNTDKEYIKKNLIGALLFDGGNTASDRRLKRTARRRYTCRRNRILYLQEIFAEEMSKVDDSFFHRLEDSFLVEDDKRGSKYPIFATMQEEKDYHEKFPTIYHLRKELADKKEKANLRLVYLALAHIIKFRGHFLIEDDSFDVRNTDIQRQYQAFLEIFDTTFENNHLLSQNIDVEGILTDKISKSAKKDRILAQYPNQKSTGIFAEFLKLIVGNQADFKKHFNLEDKTPLQFAKDSYDEDLENLLGQIGDEFADLFSVAKKLYDSVLLSGILTVTDLSTKAPLSASMIQRYDEHREDLKQLKQFVKASLPEKYQEIFTDSSKDGYAGYIEGKTNQGAFYKYLSKLLTKQEGSEYFLEKIKNEDFLRKQRTFDNGSIPHQVHLTELKAIIRRQSEYYPFLKENLDRIEKILTFRIPYYVGPLAREKSDFAWMTRKTDDSIRPWNFEELVDKEASAEAFIHRMTNNDLYLPEEKVLPKHSLIYEKFTVYNELTKVRYKNEQGETYFFDSNIKQEIFDGVFKEHRKVSKKKLLDFLAKEYEEFRIVDVIGLDKENKAFNASLGTYHDLKKILDKDFLDNPDNESILEDIVQTLTLFEDREMIKKRLENYKDLFTESQLKKLYRRHYTGWGRLSAKLINGIRDKESQKTILDYLISDGRANRNFMQLIHDDGLSFKPIIDKAQAGSHSDNLKEVVGELAGSPAIKKGILQSLKIVDELVKVMGYEPEQVVVEMARENQTTNQGRRNTRQRYKLLEEGVKNLASNILKEYPTDNQALQNERLFLYYLQNGRDMYTGEALDIDNLSQYDIDHIVPQAFIKDDSIDNRVLVSSAKNRGKSDNVPSIDIVKARKAFWKKLLDAKLMSQRKYDNLTKAERGGLTSDDKARFIQRQLVETRQITKHVARILDERFNNELDSKGRRIRKVKIVTLKSNLVSNFRKEFGFYKIREVNDYHHAHDAYLNAVVAKAILTKYPQLEPEFVYGDYPKYNSYKTRKATEKLFFYSNIMNFFKTKVTLADGTVVVKDDIEVNNDTGEIVWDKKKHFATVRKVLSYPQVNIVKKTEIQTGGFSKESILAHGNSDKLIPRKTKDIYLDPKKYGGFDSPIVAYSVLVVADIKKGKAQKLKTVTELLGITIMERFRFEKNPSAFLESKGYLNIRDDKLMILPKYSLFELENGRRRLLASAGELQKGNELALPTQYMKFLYLASRYNELKGKPEEIEQKQEFVVQHVSYFDDILQIINDFSNRVILADANLEKINKLYQDNKENISVDELANNIINLFTFTSLGAPAAFKFFDKIVDRKRYTSTKEVLNSTLIHQSITGLYETRIDLGKLGED

SEQ ID NO: 66 - protein, 1365 aa, Streptococcus agalactiae
MNKPYSIGLDIGTNSVGYSVVTDDYKVPAKKMRVLGNTDKEYIKKNLIGALLFDGGNTASDRRLKRTARRRYTRRRNRILYLQEIFAEEMSKVDDSFFHRLEDSFLVEDDKRGSKYPIFATMQEEKDYHEKFPTIYHLRKELADKKEKADLRLVYLALAHIIKFRGHFLIEDDSFDVRNTDIQRQYQAFLEIFDTTFENNHLLSQNIDVEGILTDKISKSAKKDRILAQYPNQKSTGIFAEFLKLIVGNQADFKKHFNLEDKTPLQFAKDSYDEDLENLLGQIGDEFADLFSVAKKLYDSVLLSGILTVTDLSTKAPLSASMIQRYDEHREDLKQLKQFVKASLPEKYQEIFTDSSKDGYAGYIEGKTNQGAFYKYLSKLLTKQEGSEYFLEKIKNEDFLRKQRTFDNGSIPHQVHLTELKAIIRRQSEYYPFLKENLDRIEKILTFRIPYYVGPLAREKSDFAWMTRKTDDSIRPWNFEELVDKEASAEAFIHRMTNNDLYLPEEKVLPKHSLIYEKFTVYNELTKVRYKNEQGETYFFDSNIKQEIFDGVFKEHRKVSKKKLLDFLAKEYEEFRIVDVIGLDKENKAFNASLGTYHDLKKILDKDFLDNPDNESILEDIVQTLTLFEDREMIKKRLENYKDLFTESQLKKLYRRHYTGWGRLSAKLINGIRDKESQKTILDYLISDGRANRNFMQLIHDDGLSFKPIIDKAQAGSHSDNLKEVVGELAGSPAIKKGILQSLKIVDELVKVMGYEPEQVVVEMARENQTTNQGRRNTRQRYKLLEEGVKNLASNILKEYPTDNQALQNERLFLYYLQNGRDMYTGEALDIDNLSQYDIDHIVPQAFIKDDSIDNRVLVSSAKNRGKSDNVPSIDIVKARKAFWKKLLDAKLMSQRKYDNLTKAERGGLTSDDKARFIQRQLVETRQITKHVARILDERFNNELDSKGRRIRKVKIVTLKSNLVSNFRKEFGFYKIREVNDYHHAHDAYLNAVVAKAILTKYPQLEPEFVYGDYPKYNSYKTRKATEKLFFYSNIMNFFKTKVTLADGTVVVKDDIEVNNDTGEIVWDKKKHFATVRKVLSYPQVNIVKKTEIQTGGFSKESILAHGNSDKLIPRKTKDIYLDPKKYGGFDSPIVAYSVLVVADIKKGKAQKLKTVTELLGITIMERFRFEKNPSAFLESKGYLNIRDDKLMILPKYSLFELENGRRRLLASAGELQKGNELALPTQYMKFLYLASRYNELKGKPEEIEQKQEFVVQHVSYFDDILQIINDFSNRVILADANLEKINKLYQDNKENISVDELANNIINLFTFTSLGAPAAFKFFDKIVDRKRYTSTKEVLNSTLIHQSITGLYETRIDLGKLGED

SEQ ID NO: 67 - protein, 1365 aa, Streptococcus agalactiae
MNKPYSIGLDIGTNSVGYSVVTDDYKVPAKKMRVLGNTDKEYIKKNLIGALLFDGGNTASDRRLKRTARRRYTRRRNRILYLQEIFAEEMSKVDDSFFHRLEDSFLVEDDKRGSKYPIFATMQEEKDYHEKFPTIYHLRKELADKKEKADLRLVYLALAHIIKFRGHFLIEDDSFDVRNTDIQRQYQAFLEIFDTTFENNHLLSQNIDVEGILTDKISKSAKKDRILAQYPNQKSTGIFAEFLKLIVGNQADFKKHFNLEDKTPLQFAKDSYDEDLENLLGQIGDEFADLFSVAKKLYDSVLLSGILTVTDLSTKAPLSASMIQRYDEHREDLKQLKQFVKASLPEKYQEIFTDSSKDGYAGYIEGKTNQGAFYKYLSKLLTKQEGSEYFLEKIKNEDFLRKQRTFDNGSIPHQVHLTELKAIIRRQSEYYPFLKENLDRIEKILTFRIPYYVGPLAREKSDFAWMTRKTDDSIRPWNFEELVDKEASAEAFIHRMTNNDLYLPEEKVLPKHSLIYEKFTVYNELTKVRYKNEQGETYFFDSNIKQEIFDGVFKEHRKVSKKKLLDFLAKEYEEFRIVDVIGLDKENKAFNASLGTYHDLKKILDKDFLDNPDNESILEDIVQTLTLFEDREMIKKRLENYKDLFTESQLKKLYRRHYTGWGRLSAKLINGIRDKESQKTILDYLISDGRANRNFMQLIHDDGLSFKPIIDKAQAGSHSDNLKEVVGELAGSPAIKKGILQSLKIVDELVKVMGYEPEQVVVEMARENQTTNQGRRNTRQRYKLLEEGVKNLASNILKEYPTDNQALQNERLFLYYLQNGRDMYTGETLDIDNLSQYDIDHIVPQAFIKDDSIDNRVLVSSAKNRGKSDNVPSIDIVKARKAFWKKLLDAKLMSQRKYDNLTKAERGGLTSDDKARFIQRQLVETRQITKHVARILDERFNNELDSKGRRIRKVKIVTLKSNLVSNFRKEFGFYKIREVNDYHHAHDAYLNAVVAKAILTKYPQLEREFVYGDYPKYNSYKTRKATEKLFFYSNIMNFFKTKVTLADGTVVVKDDIEVNNDTGEIVWDKKKHFATVRKVLSYPQVNIVKKTEIQTGGFSKESILAHGNSDKLIPRKTKDIYLDPKKYGGFDSPIVAYSVLVVADIKKGKAQKLKTVTELLGITIMERFRFEKNPSAFLESKGYLNIRDDKLMILPKYSLFELENGRRRLLASAGELQKGNELALPTQYMKFLYLASRYNELKGKPEEIEQKQEFVVQHVSYFDDILQIINDFSNRVILADANLEKINKLYQDNKENISVDELANNIINLFTFTSLGAPAAFKFFDKIVDRKRYTSTKEVLNSTLIHQSITGLYETRIDLGKLGED

SEQ ID NO: 68 - protein, 1365 aa, Streptococcus agalactiae
MNKPYSIGLDIGTNSVGYSVVTDDYKVPAKKMRVLGNTDKEYIKKNLIGALLFDGGNTASDRRLKRTARRRYTRRRNRILYLQEIFAEEMSKVDDSFFHRLEDSFLVEDDKRGSKYPIFATMQEEKDYHEKFPTIYHLRKELADKKEKANLRLVYLALAHIIKFRGHFLIEDDSFDVRNTDIQRQYQAFLEIFDTTFENNHLLSQNIDVEGILTDKISKSAKKDRILAQYPNQKSTGIFAEFLKLIVGNQADFKKHFNLEDKTPLQFAKDSYDEDLENLLGQIGDEFADLFSVAKKLYDSVLLSGILTVTDLSTKAPLSASMIQRYDEHREDLKQLKQFVKASLPEKYQEIFTDSSKDGYAGYIEGKTNQGAFYKYLSKLLTKQEGSEYFLEKIKNEDFLRKQRTFDNGSIPHQVHLTELKAIIRRQSEYYPFLKENLDRIEKILTFRIPYYVGPLAREKSDFAWMTRKTDDSIRPWNFEELVDKEASAEAFIHRMTNNDLYLPEEKVLPKHSLIYEKFTVYNELTKVRYKNEQGETYFFDSNIKQEIFDGVFKEHRKVSKKKLLDFLAKEYEEFRIVDVIGLDKENKAFNASLGTYHDLKKILDKDFLDNPDNESILEDIVQTLTLFEDREMIKKRLENYKDLFTESQLKKLYRRHYTGWGRLSAKLINGIRDKESQKTILDYLISDGRANRNFMQLIHDDGLSFKPIIDKAQAGSHSDNLKEVVGELAGSPAIKKGILQSLKIVDELVKVMGYEPEQVVVEMARENQTTNQGRRNTRQRYKLLEEGVKNLASNILKEYPTDNQALQNERLFLYYLQNGRDMYTGEALDIDNLSQYDIDHIVPQAFIKDDSIDNRVLVSSAKNRGKSDNVPSIDIVKARKAFWKKLLDAKLMSQRKYDNLTKAERGGLTSDDKARFIQRQLVETRQITKHVARILDERFNNELDSKGRRIRKVKIVTLKSNLVSNFRKEFGFYKIREVNDYHHAHDAYLNAVVAKAILTKYPQLEPEFVYGDYPKYNSYKTRKATEKLFFYSNIMNFFKTKVTLADGTVVVKDDIEVNNDTGEIVWDKKKHFATVRKVLSYPQVNIVKKTEIQTGGFSKESILAHGNSDKLIPRKTKDIYLDPKKYGGFDSPIVAYSVLVVADIKKGKAQKLKTVTELLGITIMERFRFEKNPSAFLESKGYLNIRDDKLMILPKYSLFELENGRRRLLASAGELQKGNELALPTQYMKFLYLASRYNELKGKPEEIEQKQEFVVQHVSYFDDILQIINDFSNRVILADANLEKINKLYQDNKENISVDELANNIINLFTFTSLGAPAAFKFFDKIVDRKRYTSTKEVLNSTLIHQFITGLYETRIDLGKLGED

SEQ ID NO: 69 - protein, 1365 aa, Streptococcus agalactiae
MNKPYSIGLDIGTNSVGYSVVTDDYKVPAKKMRVLGNTDKEYIKKNLIGALLFDGGNTASDRRLKRTARRRYTRRRNRILYLQEIFAEEMSKVDDSFFHRLEDSFLVEDDKRGSKYPIFATMQEEKDYHEKFPTIYHLRKELADKKEKANLRLVYLALAHIIKFRGHFLIEDDSFDVRNTDIQRQYQAFLEIFDTTFENNHLLSQNIDVEGILTDKISKSAKKDRILAQYPNQKSTGIFAEFLKLIVGNQADFKKHFNLEDKTPLQFAKDSYDEDLENLLGQIGDEFADLFSVAKKLYDSVLLSGILTVTDLSTKAPLSASMIQRYDEHREDLKQLKQFVKASLPEKYQEIFTDSSKDGYAGYIEGKTNQGAFYKYLSKLLTKQEGSEYFLEKIKNEDFLRKQRTFDNGSIPHQVHLTELKAIIRRQSEYYPFLKENLDRIEKILTFRIPYYVGPLAREKSDFAWMTRKTDDSIRPWNFEELVDKEASAEAFIHRMTNNDLYLPEEKVLPKHSLIYEKFTVYNELTKVRYKNEQGETYFFDSNIKQEIFDGVFKEHRKVSKKKLLDFLAKEYEEFRIVDVIGLDKENKAFNASLGTYHDLKKILDKDFLDNPDNESILEDIVQTLTLFEDREMIKKRLENYKDLFTESQLKKLYRRHYTGWGRLSAKLINGIRDKESQKTILDYLISDGRANRNFMQLIHDDGLSFKPIIDKAQAGSHSDNLKEVVGELAGSPAIKKGILQSLKIVDELVKVMGYEPEQVVVEMARENQTTNQGRRNTRQRYKLLEEGVKNLASNILKEYPTDNQALQNERLFLYYLQNGRDMYTGEALDIDNLSQYDIDHIVPQAFIKDDSIDNRVLVSSAKNRGKSDNVPSIDIVKARKAFWKKLLDAKLMSQRKYDNLTKAERGGLTSDDKARFIQRQLVETRQITKHVARILDERFNNELDSKGRRIRKVKIVTLKSNLVSNFRKEFGFYKIREVNDYHHAHDAYLNAVVAKAILTKYPQLEPEFVYGDYPKYNSYKTRKATEKLFFYSNIMNFFKTKVTLADGTVVVKDDIEVNNDTGEIVWDKKKHFATVRKVLSYPQVNIVKKTEIQTGGFSKESILAHGNSDKLIPRKTKDIYLDPKKYGGFDSPIVAYSVLVVADIKKGKAQKLKTVTELLGITIMERFRFEKNPSAFLESKGYLNIRDDKLMILPKYSLFELENGRRRLLASAGELQKGNELALPTQYMKFLYLASRYNELKGKPEEIEQKQEFVVQHVSYFDDILQIINDFSNRVILADANLEKINKLYQDNKENISVDELANNIINLFTFTSLGAPAAFKFFDKIVDRKRYTSTKEVLNSTLIHQSITGLYETRIDLGKLGED

SEQ ID NO: 70 - protein, 1365 aa, Streptococcus agalactiae
MNKPYSIGLDIGTNSVGWSIITDDYKVPAKKMRVLGNTDKEYIKKNLIGALLFDGGNTAADRRLKRTARRRYTRRRNRILYLQEIFAEEMSKVDDSFFHRLEDSFLVEEDKRGSKYPIFATMQEEKDYHEKFPTIYHLRKELADKKEKADLRLVYLALAHIIKFRGHFLIEDDRFDVRNTDIQKQYQAFLEIFDTSFENNHLLSQNVDVEAILTDKISKSAKKDRILAQYPNQKSTGIFAEFLKLIVGNQADFKKHFNLEDKTPLQFAKDSYDEDLENLLGQIGDEFADLFSAAKKLYDSVLLSGILTVTDLSTKAPLSASMIQRYDEHREDLKQLKQFVKASLPEKYQEIFADSSKDGYAGYIEGKTNQEAFYKYLSKLLTKQEDSEYFLEKIKNEDFLRKQRTFDNGSIPHQVHLTELKAIIRRQSEYYPFLKENQDKIEKILTFRIPYYVGPLARGNSDFAWMTRKTDDSIRPWNFEDLVDKEKSAEAFIHRMTNNDLYLPEEKVLPKHSLIYEKFTVYNELTKVRYKNEQGETYFFDSNVKQEIFDGVFKEHRKVSKKQLLDFLAKEFEEFRIVDVTGLDKENKAFNASLGTYHDLKKILDKDFLDNPDNESILEDIVQTITLFEDREMIKKRLENYKDLFTESQLKKLYRRHYTGWGRLSAKLINGIRDRESQKTILDYLISDGRANRNFMQLINDDGLSFKSIISKAQSGSHSDNLKEVVGELAGSPAIKKGILQSLKIVDELVKVMGYEPEQIVVEMARENQTTNQGRRNSRQRYKLLEDGVKNLASDILKEYPTDNQALQNERLFLYYLQNGRDMYTGEALDIDNLSQYDIDHIVPQAFIKDDSIDNRVLVSSAKNRGKSDDVPSIDIVKARKAFWKKLLDAKLISQRKYDNLTKAERGGLTPDDKAGFIQRQLVETRQITKHVARILDERFNNKVDDNNKPIRKVKIVTLKSNLVSNFRKEFGFYKIREVNNYHHAHDAYLNAVVAKAILTKYPQLEPEFVYGDYPKYNSYKTRKATEKLFFYSNIMNFFKTKVTLADETVVVKDDIEVNNETGEIAWDKKKHFATVRKVLSYPQVNIVKKTEVQTGGFSKESILAHSNSDKLIPRKTKDIYLDPKKYGGFDSPIVAYSVLVLADIKKGKAQKLKTVKELIGITIMERERFEKNPSAFLESKGYLNIRTDKLIILPKYSLFELENGRRRLLASAGELQKGNELALPTQYMKFLYLASRYNESKGKPEEIEKKQEFVNQHVSYFDDILQLINDFSKRVILADANLEKINKLYSDNKDNTPVDELAKNIINLFTFTSLGAPAAFKFFDKSVDRKRYTSTKEVLDSTLIHQSITGLYETRIDLGKLGED

SEQ ID NO: 71 - protein, 1365 aa, Streptococcus agalactiae
MNKPYSIGLDIGTNSVGWSIITDDYKVPAKKMRVLGNTDKEYIKKNLIGALLFDGGNTAADRRLKRTARRRYTRRRNRILYLQEIFAEEMSKVDDSFFHRLEDSFLVEEDKRGSKYPIFATMQEEKYYHEKFPTIYHLRKELADKKEKADLRLIYLALAHIIKFRGHFLIEDDRFDVRNTDIQKQYQAFLEIFDTTFENNDLLSQNVDVEAILTDKISKSAKKDRILARYPNQKSTGIFAEFLKLIVGNQADFKKHFNLEDKTPLQFAKDSYDEDLENLLGQIGDEFADLFSAAKKLYDSVLLSGILTVTDLSTKAPLSASMIQRYDEHREDLKQLKQFVKASLPEKYQEIFADSSKDGYAGYIEGKTNQEAFYKYLSKLLTKQEGSEYLLEKIKNEDFLRKQRTFDNGSIPHQVHLTELRAIIRRQSEYYPFLKENLDRIEKILTFRIPYYVGPLAREKSDFAWMTRKTDDSIRPWNFEDLVDKEKSAEAFIHRMTNNDLYLPEEKVLPKHSLIYEKFTVYNELTKVRFLAEGFKDFQFLNRKQKETIFNSLFKEKRKVTEKDIISFLNKVDGYEGIAIKGIEKQFNASLSTYHDLKKILGKDFLDNTDNELILEDIVQTLTLFEDREMIRKRLDIYKDFFTESQLKKLYRRHYTGWGRLSAKLINGIRNKENQKTILDYLIDDGSANRNFMQLIKDAGLSFKPIIDKARTGSHSDNLKEVVGELAGSPAIKKGILQSLKIVDELVKVMGYEPEQIVVEMARENQTTAKGLSRLRQRLTTLRESLANLKSEKKPKYVKDQVENHHLSDDRLFLYYLQNGKDMYTDDELDIDNLSQYDIDLIIPQAFIKDDSIDNRVLVSSAKNRGKSDDVPSVEIVKDCKVFWKKLLDAKLMSQRKYDNLTKAERGGLTSDDKARFIQRQLVETRQITKHVARILDERFNNELDSKGRRIRKVKIVTLKSNLVSNFRKEFGFYKIREVNNYHHAHDAYLNAVVAKAILTKYPQLEPEFVYGDYPKYNSYKTRKATEKLFFYSNIMNFFKTKVTLADGTVVVKDDIEVNNDTGEIVWDKKKHFATVRKVLSYPQVNIVKKTEIQTGGFSKESILAHGNSDKLIPRKTKDIYLDPKKYGGFDSPIVAYSVLVVADIKKGKAQKLKTVTELLGITIMERSRFEKNPSAFLESKGYLNIRDDKLMILPKYSLFELENGRRRLLASADELQKGNELALPTQFMKFLYLASRYNELKGKPEEIEQKQEFVVQHVSYFDDILQIINDFSNRVILADANLEKINKLYQDNKENIPVDELANNIINLFTFTSLGAPAAFKFFDKIVDRKRYTSTKEVLNSTLIHQSITGLYETRIDLGKLGED

SEQ ID NO: 72 - protein, 1365 aa, Streptococcus agalactiae
MNKPYSIGLDIGTNSVGWSIITDDYKVPAKKMRVLGNTDKEYIKKNLIGALLFDGGNTASDRRLKRTARRRYTRRRNRILYLQEIFAEEMSKVDDSFFHRLEDSFLVEDDKRGSKYPIFATMQEEKDYHEKFPTIYHLRKELADKKEKADLRLFYLALAHIIKFRGHFLIEDDSFDVRNTDIQRQYQAFLEIFDTTFENNHLLSQNIDIEGILTDKISKSAKKDRILAQYPNQKSTGIFAEFLKLIVGNQADFKKHFNLEDKTPLQFAKDSYDEDLENLLGQIGDEFADLFSVAKKLYDSVLLSGILTVTDLSTKAPLSASMIQRYDEHREDLKQLKQFVKASLPEKYQEIFTDSSKDGYAGYIEGKTNQGAFYKYLSKLLTKQEGSEYFLEKIKNEDFLRKQRTFDNGSIPHQVHLTELKAIIRRQSEYYPFLKENLDRIEKILTFRIPYYVGPLAREKSDFAWMTRKTDDSIRPWNFEELVDKEASAEAFIHRMTNNDLYLPEEKVLPKHSLIYEKFTVYNELTKVRYKNEQGETYFFDSNIKQEIFDGVFKEHRKVSKKKLLDFLAKEYEEFRIVDVIGLDKENKAFNASLGTYHDLKKILDKDFLDNPDNESILEDIVQTLTLFEDREMIKKRLENYKDLFTESQLKKLYRRHYTGWGRLSAKLINGIRDKESQKTILDYLIDDGKSNRNFMQLIHDDGLSFKSIISKAQAGSHSDNLKEVVGELAGSPAIKKGILQSLKIVDELVKVMGYEPEQIVVEMARENQTTNQGRRNSRQRYKLLDDGVKNLASNILKEYPTDNQALQNERLFLYYLQNGRDMYTGKALDIDNLSQYDIDHIIPQAFIKDDSIDNRVLVSSAKNRGKSDDVPSLEIVKDCKVFWKKLLDAKLMSQRKYDNLTKAERGGLTSDDKARFIQRQLVETRQITKHVARILDERFNNELDSKGRRIRKVKIVTLKSNLVSNFRKEFGFYKIREVNNYHHAHDAYLNAVVAKAILTKYPQLEPEFVYGDYPKYNSYKTRKATEKLFFYSNIMNFFKTKVTLADGTVVVKDDIEVNNDTGEIVWDKKKHFATVRKVLSYPQVNIVKKTEIQTGGFSKESILAHGNSDKLIPRKTKDIYLDPKKYGGFDSPIVAYSVLVVADIKKGKAQKLKTVTELLGITIMERSRFEKNPSAFLESKGYLNIRDDKLMILPKYSLFELENGRRRLLASAGELQKGNELALPTQFMKFLYLASRYNELKGKPEEIEQKQEFVVQHVSYFDDILQIINDFSNRVILADANLEKINKLYQDNKENISVDELANNIINLFTFTSLGAPAAFKFFDKIVDRKRYTSTKEVLNSTLIHQSITGLYETRIDLGKLGED

SEQ ID NO: 73 - protein, 1365 aa, Streptococcus agalactiae
MNKPYSIGLDIGTNSVGWSIITDDYKVPAKKMRVLGNTDKEYIKKNLIGALLFDGGNTASDRRLKRTARRRYTRRRNRILYLQEIFAEEMSKVDDSFFHRLEDSFLVEDDKRGSKYPIFATMQEEKDYHEKFPTIYHLRKELADKKEKADLRLFYLALAHIIKFRGHFLIEDDSFDVRNTDIQRQYQAFLEIFDTTFENNHLLSQNIDVEGILTDKISKSAKKDRILAQYPNQKSTGIFAEFLKLIVGNQADFKKHFNLEDKTPLQFAKDSYDEDLENLLGQIGDEFADLFSVAKKLYDSVLLSGILTVTDLSTKAPLSASMIQRYDEHREDLKQLKQFVKASLPEKYQEIFTDSSKDGYAGYIEGKTNQGAFYKYLSKLLTKQEGSEYFLEKIKNEDFLRKQRTFDNGSIPHQVHLTELKAIIRRQSEYYPFLKENLDRIEKILTFRIPYYVGPLAREKSDFAWMTRKTDDSIRPWNFEELVDKEASAEAFIHRMTNNDLYLPEEKVLPKHSLIYEKFTVYNELTKVRYKNEQGETYFFDSNIKQEIFDGVFKEHRKVSKKKLLDFLAKEYEEFRIVDVIGLDKENKAFNASLGTYHDLKKILDKDFLDNPDNESILEDIVQTLTLFEDREMIKKRLENYKDLFTESQLKKLYRRHYTGWGRLSAKLINGIRDKESQKTILDYLIDDGKSNRNFMQLIHDDGLSFKSIISKAQAGSHSDNLKEVVGELAGSPAIKKGILQSLKIVDELVKVMGYEPEQIVVEMARENQTTNQGRRNSRQRYKLLDDGVKNLASNILKEYPTDNQALQNERLFLYYLQNGRDMYTGKALDIDNLSQYDIDHIIPQAFIKDDSIDNRVLVSSAKNRGKSDDVPSLEIVKDCKVFWKKLLDAKLMSQRKYDNLTKAERGGLTSDDKARFIQRQLVETRQITKHVARILDERFNNELDSKGRRIRKVKIVTLKSNLVSNFRKEFGFYKIREVNNYHHAHDAYLNAVVAKAILTKYPQLEPEFVYGDYPKYNSYKTRKATEKLFFYSNIMNFFKTKVTLADGTVVVKDDIEVNNDTGEIVWDKKKHFATVRKVLSYPQVNIVKKTEIQTGGFSKESILAHGNSDKLIPRKTKDIYLDPKKYGGFDSPIVAYSVLVVADIKKGKAQKLKTVTELLGITIMERSRFEKNPSAFLESKGYLNIRDDKLMILPKYSLFELENGRRRLLASAGELQKGNELALPTQFMKFLYLASRYNELKGKPEEIEQKQEFVVQHVSYFDDILQIINDFSNRVILADANLEKINKLYQDNKENISVDELANNIINLFTFTSLGAPAAFKFFDKIVDRKRYTSTKEVLNSTLIHQSITGLYETRIDLGKLGED

SEQ ID NO: 74 - protein, 1365 aa, Streptococcus agalactiae
MNKPYSIGLDIGTNSVGWSIITDDYKVPAKKMRVLGNTDKEYIKKNLIGALLFDGGNTAADRRLKRTARRRYTRRRNRILYLQEIFAEEMSKVDDSFFHRLEDSFLVEEDKRGSKYPIFATLQEEKDYHEKFPTIYHLRKELADKKEKADLRLIYIALAHIIKFRGHFLIEDDSFDVRNTDISKQYQDFLEIFNTTFENNDLLSQNVDVEAILTDKISKSAKKDRILAQYPNQKSTGIFAEFLKLIVGNQADFKKYFNLEDKTPLQFAKDSYDEDLENLLGQIGDEFADLFSAAKKLYDSVLLSGILTVIDLSTKAPLSASMIQRYDEHREDLKQLKQFVKASLPEKYQEIFADSSKDGYAGYIEGKTNQEAFYKYLSKLLTKQEDSENFLEKIKNEDFLRKQRTFDNGSIPHQVHLTELKAIIRRQSEYYPFLKENQDRIEKILTFRIPYYIGPLAREKSDFAWMTRKTDDSIRPWNFEDLVDKEKSAEAFIHRMTNNDFYLPEEKVLPKHSLIYEKFTVYNELTKVRYKNEQGETYFFDSNIKQEIFDGVFKEHRKVSKKKLLDFLAKEYEEFRIVDVIGLDKENKAFNASLGTYHDLEKILDKDFLDNPDNESILEDIVQTLTLFEDREMIKKRLENYKDLFTESQLKKLYRRHYTGWGRLSAKLINGIRDKESQKTILDYLIDDGRSNRNFMQLINDDGLSFKSIISKAQAGSHSDNLKEVVGELAGSPAIKKGILQSLKIVDELVKVMGYEPEQIVVEMARENQTTNQGRRNSRQRYKLLDDGVKNLASNILKEYPTDNQALQNERLFLYYLQNGRDMYTGEALDIDNLSQYDIDHIIPQAFIKDDSIDNRVLVSSAKNRGKSDDVPSLEIVKDCKVFWKKLLDAKLMSQRKYDNLTKAERGGLTSDDKARFIQRQLVETRQITKHVARILDERFNNELDSKGRRIRKVKIVTLKSNLVSNFRKEFGFYKIREVNNYHHAHDAYLNAVVAKAILTKYPQLEPEFVYGDYPKYNSYKTRKATEKLFFYSNIMNFFKTKVTLADGTVVVKDDIEVNNDTGEIVWDKKKHFATVRKVLSYPQNNIVKKTEIQTGGFSKESILAHGNSDKLIPRKTKDIYLDPKKYGGFDSPIVAYSVLVVADIKKGKAQKLKTVTELLGITIMERSRFEKNPSAFLESKGYLNIRADKLIILPKYSLFELENGRRRLLASAGELQKGNELALPTQFMKFLYLASRYNESKGKPEEIEKKQEFVNQHVSYFDDILQLINDFSKRVILADANLEKINKLYQDNKENISVDELANNIINLFTFTSLGAPAAFKFFDKIVDRKRYTSTKEVLNSTLIHQSITGLYETRIDLGKLGED

SEQ ID NO: 75 - protein, 1365 aa, Streptococcus agalactiae
MNKPYSIGLDIGTNSVGYSVVTDDYKVPAKKMRVLGNTDKEYIKKNLIGALLFDGGNTASDRRLKRTARRRYTRRRNRILYLQEIFAEEMSKVDDSFFHRLEDSFLVEDDKRGSKYPIFATMQEEKDYHEKFPTIYHLRKELADKKEKADLRLVYLALAHIIKFRGHFLIEDDSFDVRNTDIQRQYQAFLEIFDTTFENNHLLSQNIDVEGILTDKISKSAKKDRILAQYPNQKSTGIFAEFLKLIVGNQADFKKHFNLEDKTPLQFAKDSYDEDLENLLGQIGDEFADLFSVAKKLYDSVLLSGILTVTALSTKAPLSASMIQRYDEHREDLKQLKQFVKASLPEKYQEIFTDSSKDGYAGYIEGKTNQGAFYKYLSKLLTKQEGSEYFLEKIKNEDFLRKQRTFDNGSIPHQVHLTELKAIIRRQSEYYPFLKENLDRIEKILTFRIPYYVGPLAREKSDFAWMTRKTDDSIRPWNFEELVDKEASAEAFIHRMTNNDLYLPEEKVLPKHSLIYEKFTVYNELTKVRYKNEQGETYFFDSNIKQEIFDGVFKEHRKVSKKKLLDFLAKEYEEFRIVDVIGLDKENKAFNASLGTYHDLKKILDKDFLDNPDNESILEDIVQTLTLFEDREMIKKRLENYKDLFTESQLKKLYRRHYTGWGRLSAKLINGIRDKESQKTILDYLISDGRANRNFMQLIHDDGLSFKPIIDKAQAGSHSDNLKEVVGELAGSPAIKKGILQSLKIVDELVKVMGYEPEQVVVEMARENQTTNQGRRNTRQRYKLLEEGVKNLASNILKEYPTDNQALQNERLFLYYLQNGRDMYTGEALDIDNLSQYDIDHIVPQAFIKDDSIDNRVLVSSAKNRGKSDNVPSIDIVKARKAFWKKLLDAKLMSQRKYDNLTKAERGGLTSDDKARFIQRQLVETRQITKHVARILDERFNNELDSKGRRIRKVKIVTLKSNLVSNFRKEFGFYKIREVNDYHHAHDAYLNAVVAKAILTKYPQLEPEFVYGDYPKYNSYKTRKATEKLFFYSNIMNFFKTKVTLADGTVVVKDDIEVNNDTGEIVWDKKKHFATVRKVLSYPQVNIVKKTEIQTGGFSKESILAHGNSDKLIPRKTKDIYLDPKKYGGFDSPIVAYSVLVVADIKKGKAQKLKTVTELLGITIMERFRFEKNPSAFLESKGYLNIRDDKLMILPKYSLFELENGRRRLLASAGELQKGNELALPTQYMKFLYLASRYNELKGKPEEIEQKQEFVVQHVSYFDDILQIINDFSNRVILADANLEKINKLYQDNKENISVDELANNIINLFTFTSLGAPAAFKFFDKIVDRKRYTSTKEVLNSTLIHQSITGLYETRIDLGKLGED

SEQ ID NO: 76 - protein, 1365 aa, Streptococcus agalactiae
MNKPYSIGLDIGTNSVGWSIITDDYKVPAKKMRVLGNTDKEYIKKNLIGALLFDGGNTAADRRLKRTARRRYTRRRNRILYLQEIFAEEMSKVDDSFFHRLEDSFLVEEDKRGSKYPIFATLQEEKDYHEKFSTIYHLRKELADKKEKADLRLIYIALAHIIKFRGHFLIEDDSFDVRNTDISKQYQDFLEIFNTTFENNDLLSQNVDVEAILTDKISKSAKKDRILAQYPNQKSTGIFAEFLKLIVGNQADFKKYFNLEDKTPLQFAKDSYDEDLENLLGQIGDEFADLFSAAKKLYDSVLLSGILTVIDLSTKAPLSASMIQRYDEHREDLKQLKQFVKASLPEKYQEIFADSSKDGYAGYIEGKTNQEAFYKYLSKLLTKQEDSENFLEKIKNEDFLRKQRTFDNGSIPHQVHLTELKAIIRRQSEYYPFLKENQDRIEKILTFRIPYYIGPLAREKSDFAWMTRKTDDSIRPWNFEDLVDKEKSAEAFIHRMTNNDFYLPEEKVLPKHSLIYEKFTVYNELTKVRYKNEQGETYFFDSNIKQEIFDGVFKEHRKVSKKKLLDFLAKEYEEFRIVDVIGLDKENKAFNASLGTYHDLEKILDKDFLDNPDNESILEDIVQTLTLFEDREMIKKRLENYKDLFTESQLKKLYRRHYTGWGRLSAKLINGIRDKESQKTILDYLIDDGRSNRNFMQLINDDGLSFKSIISKAQAGSHSDNLKEVVGELAGSPAIKKGILQSLKIVDELVKVMGYEPEQIVVEMARENQTTNQGRRNSRQRYKLLDDGVKNLASNILKEYPTDNQALQNERLFLYYLQNGRDMYTGEALDIDNLSQYDIDHIIPQAFIKDDSIDNRVLVSSAKNRGKSDDVPSLEIVKDCKVFWKKLLDAKLMSQRKYDNLTKAERGGLTSDDKARFIQRQLVETRQITKHVARILDERFNNELDSKGRRIRKVKIVTLKSNLVSNFRKEFGFYKIREVNNYHHAHDAYLNAVVAKAILTKYPQLEPEFVYGDYPKYNSYKTRKATEKLFFYSNIMNFFKTKVTLADGTVVVKDDIEVNNDTGEIVWDKKKHFATVRKVLSYPQNNIVKKTEIQTGGFSKESILAHGNSDKLIPRKTKDIYLDPKKYGGFDSPIVAYSVLVAADIKKGKAQKLKTVTELLGITIMERSRFEKNPSAFLESKGYLNIRADKLIILPKYSLFELENGRRRLLASAGELQKGNELALPTQFMKFLYLASRYNESKGKPEEIEKKQEFVNQHVSYFDDILQLINDFSKRVILADANLEKINKLYQDNKENISVDELANNIINLFTFTSLGAPAAFKFFDKIVDRKRYTSTKEVLNSTLIHQSITGLYETRIDLGKLGED

SEQ ID NO: 77 - protein, 1365 aa, Streptococcus agalactiae
MNKPYSIGLDIGTNSVGWSIITDDYKVPAKKMRVLGNTDKEYIKKNLIGALLFDGGNTAADRRLKRTARRRYTRRRNRILYLQEIFAEEMSKVDDSFFHRLEDSFLVEEDKRGSKYPIFATLQEEKDYHEKFSTIYHLRKELADKKEKADLRLIYIALAHIIKFRGHFLIEDDSFDVRNTDISKQYQDFLEIFNTTFENNDLLSQNVDVEAILTDKISKSAKKDRILAQYPNQKSTGIFAEFLKLIVGNQADFKKYFNLEDKTPLQFAKDSYDEDLENLLGQIGDEFADLFSAAKKLYDSVLLSGILTVIDLSTKASLSDSMIQRYDEHREDLKQLKQFVKASLPEKYQEIFADSSKDGYAGYIEGKTNQEAFYKYLSKLLTKQEDSENFLEKIKNEDFLRKQRTFDNGSIPHQVHLTELKAIIRRQSEYYPFLKENQDRIEKILTFRIPYYIGPLAREKSDFAWMTRKTDDSIRPWNFEDLVDKEKSAEAFIHRMTNNDFYLPEEKVLPKHSLIYEKFTVYNELTKVRYKNEQGETYFFDSNIKQEIFDGVFKEHRKVSKKKLLDFLAKEYEEFRIVDVIGLDKENKAFNASLGTYHDLEKILDKDFLDNPDNESILEDIVQTLTLFEDREMIKKRLENYKDLFTESQLKKLYRRHYTGWGRLSAKLINGIRDKESQKTILDYLIDDGRSNRNFMQLINDDGLSFKSIISKAQAGSHSDNLKEVVGELAGSPAIKKGILQSLKIVDELVKVMGYEPEQIVVEMARENQTTNQGRRNSRQRYKLLDDGVKNLASNILKEYPTDNQALQNERLFLYYLQNGRDMYTGEALDIDNLSQYDIDHIIPQAFIKDDSIDNRVLVSSAKNRGKSDDVPSLEIVKDCKVFWKKLLDAKLMSQRKYDNLTKAERGGLTSDDKARFIQRQLVETRQITKHVARILDERFNNELDSKGRRIRKVKIVTLKSNLVSNFRKEFGFYKIREVNNYHHAHDAYLNAVVAKAILTKYPQLEPEFVYGDYPKYNSYKTRKATEKLFFYSNIMNFFKTKVTLADGTVVVKDDIEVNNDTGEIVWDKKKHFATVRKVLSYPQNNIVKKTEIQTGGFSKESILAHGNSDKLIPRKTKDIYLDPKKYGGFDSPIVAYSVLVVADIKKGKAQKLKTVTELLGITIMERSRFEKNPSAFLESKGYLNIRADKLIILPKYSLFELENGRRRLLASAGELQKGNELALPTQFMKFLYLASRYNESKGKPEEIEKKQEFVNQHVSYFDDILQLINDFSKRVILADANLEKINKLYQDNKENISVDELANNIINLFTFTSLGAPAAFKFFDKIVDRKRYTSTKEVLNSTLIHQSITGLYETRIDLGKLGED

SEQ ID NO: 78 - protein, 1365 aa, Streptococcus agalactiae
MNKPYSIGLDIGTNSVGWSIITDDYKVPAKKMRVLGNTDKEYIKKNLIGALLFDGGNTAADRRLKRTARRRYTRRRNRILYLQEIFAEEMSKVDDSFFHRLEDSFLVEEDKRGSKYPIFATLQEEKDYHEKFSTIYHLRKELADKKEKADLRLIYIALAHIIKFRGHFLIEDDSFDVRNTDISKQYQDFLEIFNTTFENNDLLSQNVDVEAILTDKISKSAKKDRILAQYPNQKSTGIFAEFLKLIVGNQADFKKYFNLEDKTPLQFAKDSYDEDLENLLGQIGDEFADLFSAAKKLYDSVLLSGILTVIDLSTKAPLSASMIQRYDEHREDLKQLKQFVKASLPEKYQEIFADSSKDGYAGYIEGKTNQEAFYKYLSKLLTKQEDSENFLEKIKNEDFLRKQRTFDNGSIPHQVHLTELKAIIRRQSEYYPFLKENQDRIEKILTFRIPYYIGPLAREKSDFAWMTRKTDDSIRPWNFEDLVDKEKSAEAFIHRMTNNDFYLPEEKVLPKHSLIYEKFTVYNELTKVRYKNEQGETYFFDSNIKQEIFDGVFKEHRKVSKKKLLDFLAKEYEEFRIVDVIGLDKENKAFNASLGTYHDLEKILDKDFLDNPDNESILEDIVQTLTLFEDREMIKKRLENYKDLFTESQLKKLYRRHYTGWGRLSAKLINGIRDKESQKTILDYLIDDGRSNRNFMQLINDDGLSFKSIISKAQAGSHSDNLKEVVGELAGSPAIKKGILQSLKIVDELVKVMGYEPEQIVVEMARENQTTNQGRRNSRQRYKLLDDGVKNLASNILKEYPTDNQALQNERLFLYYLQNGRDMYTGEALDIDNLSQYDIDHIIPQAFIKDDSIDNRVLVSSAKNRGKSDDVPSLEIVKDCKVFWKKLLDAKLMSQRKYDNLTKAERGGLTSDDKARFIQRQLVEIRQITKHVARILDERFNNELDSKGRRIRKVKIVTLKSNLVSNFRKEFGFYKIREVNNYHHAHDAYLNAVVAKAILTKYPQLEPEFVYGDYPKYNSYKTRKATEKLFFYSNIMNFFKTKVTLADGTVVVKDDIEVNNDTGEIVWDKKKHFATVRKVLSYPQNNIVKKTEIQTGGFSKESILAHGNSDKLIPRKTKDIYLDPKKYGGFDSPIVAYSVLVVADIKKGKAQKLKTVTELLGITIMERSRFEKNPSAFLESKGYLNIRADKLIILPKYSLFELENGRRRLLASAGELQKGNELALPTQFMKFLYLASRYNESKGKPEEIEKKQEFVNQHVSYFDDILQLINDFSKRVILADANLEKINKLYQDNKENISVDELANNIINLFTFTSLGAPAAFKFFDKIVDRKRYTSTKEVLNSTLIHQSITGLYETRIDLGKLGED

SEQ ID NO: 79 - protein, 1365 aa, Streptococcus agalactiae
MNKPYSIGLDIGTNSVGWSIITDDYKVPAKKMRVLGNTDKEYIKKNLIGALLFDGGNTAADRRLKRTARRRYTRRRNRILYLQEIFAEEMSKVDDSFFHRLEDSFLVEEDKRGSKYPIFATLQEEKDYHEKFSTIYHLRKELADKKEKADLRLIYIALAHIIKFRGHFLIEDDSFDVRNTDISKQYQDFLEIFNTTFENNDLLSQNVDVEAILTDKISKSAKKDRILAQYPNQKSTGIFAEFLKLIVGNQADFKKYFNLEDKTPLQFAKDSYDEDLENLLGQIGDEFADLFSAAKKLYDSVLLSGILTVIDLSTKAPLSASMIQRYDEHREDLKQLKQFVKASLPEKYQEIFADSSKDGYAGYIEGKTNQEAFYKYLSKLLTKQEDSENFLEKIKNEDFLRKQRTFDNGSIPHQVHLTELKAIIRRQSEYYPFLKENQDRIEKILTFRIPYYIGPLAREKSDFAWMTRKTDDSIRPWNFEDLVDKEKSAEAFIHRMTNNDFYLPEEKVLPKHSLIYEKFTVYNELTKVRYKNEQGETYFFDSNIKQEIFDGVFKEHRKVSKKKLLDFLAKEYEEFRIVDVIGLDKENKAFNASLGTYHDLEKILDKDFLDNPDNESILEDIVQTLTLFEDREMIKKRLENYKDLFTESQLKKLYRRHYTGWGRLSAKLINGIRDKESQKTILDYLIDDGRSNRNFMQLINDDGLSFKSIISKAQAGSHSDNLKEVVGELAGSPAIKKGILQSLKIVDELVKVMGYEPEQIVVEMARENQTTNQGRRNSRQRYKLLDDGVKNLASNILKEYPTDNQALQNERLFLYYLQNGRDMYTGEALDIDNLSQYDIDHIIPQAFIKDDSIDNRVLVSSAKNRGKSDDVPSLEIVKDCKVFWKKLLDAKLMSQRKYDNLTKAERGGLTSDDKARFIQRQLVETRQITKHVARILDERFNNELDSKGRRIRKVKIVTVKSNLVSNFRKEFGFYKIREVNNYHHAHDAYLNAVVAKAILTKYPQLEPEFVYGDYPKYNSYKTRKATEKLFFYSNIMNFFKTKVTLADGTVVVKDDIEVNNDTGEIVWDKKKHFATVRKVLSYPQNNIVKKTEIQTGGFSKESILAHGNSDKLIPRKTKDIYLDPKKYGGFDSPIVAYSVLVVADIKKGKAQKLKTVTELLGITIMERSRFEKNPSAFLESKGYLNIRADKLIILPKYSLFELENGRRRLLASAGELQKGNELALPTQFMKFLYLASRYNESKGKPEEIEKKQEFVNQHVSYFDDILQLINDFSKRVILADANLEKINKLYQDNKENISVDELANNIINLFTFTSLGAPAAFKFFDKIVDRKRYTSTKEVLNSTLIHQSITGLYETRIDLGKLGED

SEQ ID NO: 80 - protein, 1365 aa, Streptococcus agalactiae
MNKPYSIGLDIGTNSVGWSIITDDYKVPAKKMRVLGNTDKEYIKKNLIGALLFDGGNTAADRRLKRTARRRYTRRRNRILYLQEIFAEEMSKVDDSFFHRLEDSFLVEEDKRGSKYPIFATLQEEKDYHEKFSTIYHLRKELADKKEKADLRLIYIALAHIIKFRGHFLIEDDSFDVRNTDISKQYQDFLEIFNTTFENNDLLSQNVDVEAILTDKISKSAKKDRILAQYPNQKSTGIFAEFLKLIVGNQADFKKYFNLEDKTPLQFAKDSYDEDLENLLGQIGDEFADLFSAAKKLYDSVLLSGILTVIDLSTKAPLSASMIQRYDEHREDLKQLKQFVKASLPEKYQEIFADSSKDGYAGYIEGKTNQEAFYKYLSKLLTKQEDSENFLEKIKNEDFLRKQRTFDNGSIPHQVHLTELKAIIRRQSEYYPFLKENQDRIEKILTFRIPYYIGPLAREKSDFAWMTRKTDDSIRPWNFEDLVDKEKSAEAFIHRMTNNDFYLPEEKVLPKHSLIYEKFTVYNELTKVRYKNEQGETYFFDSNIKQEIFDGVFKEHRKVSKKKLLDFLAKEYEEFRIVDVIGLDKENKAFNASLGTYHDLEKILDKDFLDNPDNESILEDIVQTLTLFEDREMIKKRLENYKDLFTESQLKKLYRRHYTGWGRLSAKLINGIRDKESQKTILDYLIDDGRSNRNFMQLINDDGLSFKSIISKAQAGSHSDNLKEVVGELAGSPAIKKGILQSLKIVDELVKVMGYEPEQIVVEMARENQTTNQGRRNSRQRYKLLDDGVKNLASNILKEYPTDNQALQNERLFLYYLQNGRDMYTGEALDIDNLSQYDIDHIIPQAFIKDDSIDNRVLVSSAKNRGKSDDVPSLEIVKDCKVFWKKLLDAKLMSQRKYDNLTKAERGGLTSDDKARFIQRQLVETRQITKHVARILDELFNNELDSKGRRIRKVKIVTLKSNLVSNFRKEFGFYKIREVNNYHHAHDAYLNAVVAKAILTKYPQLEPEFVYGDYPKYNSYKTRKATEKLFFYSNIMNFFKTKVTLADGTVVVKDDIEVNNDTGEIVWDKKKHFATVRKVLSYPQNNIVKKTEIQTGGFSKESILAHGNSDKLIPRKTKDIYLDPKKYGGFDSPIVAYSVLVVADIKKGKAQKLKTVTELLGITIMERSRFEKNPSAFLESKGYLNIRADKLIILPKYSLFELENGRRRLLASAGELQKGNELALPTQFMKFLYLASRYNESKGKPEEIEKKQEFVNQHVSYFDDILQLINDFSKRVILADANLEKINKLYQDNKENISVDELANNIINLFTFTSLGAPAAFKFFDKIVDRKRYTSTKEVLNSTLIHQSITGLYETRIDLGKLGGD

SEQ ID NO: 81 - protein, 1365 aa, Streptococcus agalactiae; identical to SEQ ID NO: 50

SEQ ID NO: 82 - protein, 1365 aa, Streptococcus agalactiae
MNKPYSIGLDIGTNSVGYSVVTDDYKVPAKKMRVLGNTDKEYIKKNLIGALLFDGGNTASDRRLKRTARRRYTRRRNRILYLQEIFAEEMSKVDDSFFHRLEDSFLVEDDKRGSKYPIFATMQEEKDYHEKFPTIYHLRKELADKKEKANLRLVYLALAHIIKFRGHFLIEDDSFDVRNTDIQRQYQAFLEIFDTTFENNHLLSQNIDVEGILTDKISKSAKKDRILAQYPNQKSTGIFAEFLKLIVGNQADFKKHFNLEDKTPLQFAKDSYDEDLENLLGQIGDEFADLFSVAKKLYDSVLLSGILTVTDLSTKAPLSASMIQRYDEHREDLKQLKQFVKASLPEKYQEIFTDSSKDGYAGYIEGKTNQGAFYKYLSKLLTKQEGSEYFLEKIKNEDFLRKQRTFDNGSIPHQVHLTELKAIIRRQSEYYPFLKENLDRIEKILTFRIPYYVGPLAREKSDFAWMTRKTDDSIRPWNFEELVDKEASAEAFIHRMTNNDLYLPEEKVLPKHSLIYEKFTVYNELTKVRYKNEQGETYFFDSNIKQEIFDGVFKEHRKVSKKKLLDFLAKEYEEFRIVDVIGLDKENKAFNASLGTYHDLKKILDKDFLDNPDNESILEDIVQTLTLFEDREMIKKRLENYKDLFTESQLKKLYRRHYTGWGRLSAKLINGIRDKESQKTILDYLISDGRANRNFMQLIHDDGLSFKPIIDKAQAGSHSDNLKEVVGELAGSPAIKKGILQSLKIVDELVKVMGYEPEQVVVEMARENQTTNKGRRNTRQRYKLLEEGVKNLASNILKEYPTDNQALQNERLFLYYLQNGRDMYTGEALDIDNLSQYDIDHIVPQAFIKDDSIDNRVLVSSAKNRGKSDNVPSIDIVKARKAFWKKLLDAKLMSQRKYDNLTKAERGGLTSDDKARFIQRQLVETRQITKHVARILDERFNNELDSKGRRIRKVKIVTLKSNLVSNFRKEFGFYKIREVNDYHHAHDAYLNAVVAKAILTKYPQLEPEFVYGDYPKYNSYKTRKATEKLFFYSNIMNFFKTKVTLADGTVVVKDDIEVNNDTGEIVWDKKKHFATVRKVLSYPQVNIVKKTEIQTGGFSKESILAHGNSDKLIPRKTKDIYLDPKKYGGFDSPIVAYSVLVVADIKKGKAQKLKTVTELLGITIMERFRFEKNPSAFLESKGYLNIRDDKLMILPKYSLFELENGRRRLLASAGELQKGNELALPTQYMKFLYLASRYNELKGKPEEIEQKQEFVVQHVSYFDDILQIINDFSNRVILADANLEKINKLYQDNKENISVDELANNIINLFTFTSLGAPAAFKFFDKIVDRKRYTSTKEVLNSTLIHQSITGLYETRIDLGKLGED

SEQ ID NO: 83 - protein, 1365 aa, Streptococcus agalactiae
MNKPYSIGLDIGTNSVGWSIITDDYKVPAKKMRVLGNTDKEYIKKNLIGALLFDGRNTAADRRLKRTARRRYTRRRNRILYLQEIFAEEMSKVDDSFFHRLEDSFLVEEDKRGSKYPIFATLQEEKDYHEKFSTIYHLRKELADKKEKADLRLIYIALAHIIKFRGHFLIEDDSFDVRNTDISKQYQDFLEIFNTTFENNDLLSQNVDVEAILTDKISKSAKKDRILAQYPNQKSTGIFAEFLKLIVGNQADFKKYFNLEDKTPLQFAKDSYDEDLENLLGQIGDEFADLFSAAKKLYDSVLLSGILTVIDLSTKAPLSASMIQRYDEHREDLKQLKQFVKASLPEKYQEIFADSSKDGYAGYIEGKTNQEAFYKYLSKLLTKQEDSENFLEKIKNEDFLRKQRTFDNGSIPHQVHLTELKAIIRRQSEYYPFLKENQDRIEKILTFRIPYYIGPLAREKSDFAWMTRKTDDSIRPWNFEDLVDKEKSAEAFIHRMTNNDFYLPEEKVLPKHSLIYEKFTVYNELTKVRYKNEQGETYFFDSNIKQEIFDGVFKEHRKVSKKKLLDFLAKEYEEFRIVDVIGLDKENKAFNASLGTYHDLEKILDKDFLDNPDNESILEDIVQTLTLFEDREMIKKRLENYKDLFTESQLKKLYRRHYTGWGRLSAKLINGIRDKESQKTILDYLIDDGRSNRNFMQLINDDGLSFKSIISKAQAGSHSDNLKEVVGELAGSPAIKKGILQSLKIVDELVKVMGYEPEQIVVEMARENQTTNQGRRNSRQRYKLLDDGVKNLASNILKEYPTDNQALQNERLFLYYLQNGRDMYTGEALDIDNLSQYDIDHIIPQAFIKDDSIDNRVLVSSAKNRGKSDDVPSLEIVKDCKVFWKKLLDAKLMSQRKYDNLTKAERGGLTSDDKARFIQRQLVETRQITKHVARILDERFNNELDSKGRRIRKVKIVTLKSNLVSNFRKEFGFYKIREVNNYHHAHDAYLNAVVAKAILTKYPQLEPEFVYGDYPKYNSYKTRKATEKLFFYSNIMNFFKTKVTLADGTVVVKDDIEVNNDTGEIVWDKKKHFATVRKVLSYPQNNIVKKTEIQTGGFSKESILAHGNSDKLIPRKTKDIYLDPKKYGGFDSPIVAYSVLVVADIKKGKAQKLKTVTELLGITIMERSRFEKNPSAFLESKGYLNIRADKLIILPKYSLFELENGRRRLLASAGELQKGNELALPTQFMKFLYLASRYNESKGKPEEIEKKQEFVNQHVSYFDDILQLINDFSKRVILADANLEKINKLYQDNKENISVDELANNIINLFTFTSLGAPAAFKFFDKIVDRKRYTSTKEVLNSTLIHQSITGLYETRIDLGKLGED

SEQ ID NO: 84 - protein, 1365 aa, Streptococcus agalactiae
MNKPYSIGLDIGTNSVGWSIITDDYKVPAKKMRVLGNTDKEYIKKNLIGALLFDGGNTAADRRLKRTARRRYTRRRNRILYLQEIFAEEMSKVDDSFFHRLEDSFLVEEDKRGSKYPIFATMQEEKYYHEKFPTIYHLRKELADKKEKADLRLIYLALAHIIKFRGHFLIEDDSFDVRNTDIQKQYQAFLEIFDTTFENNDLLSQNVDVEAILTDKISKSAKKDRILARYPNQKSTGIFAEFLKLIVGNQADFKKHFNLEDKTPLQFAKDSYDEDLENLLGQIGDEFADLFSAAKKLYDSVLLSGILTVTDLSTKAPLSASMIQRYDEHREDLKQLKQFVKASLPEKYQEIFADSSKDGYAGYIEGKTNQEAFYKYLSKLLTKQEGSEYLLEKIKNEDFLRKQRTFDNGSIPHQVHLTELRAIIRRQSEYYPFLKENLDRIEKILTFRIPYYVGPLAREKSDFAWMTRKTDDSIRPWNFEDLVDKEKSAEAFIHRMTNNDLYLPEEKVLPKHSLIYEKFTVYNELTKVRFLAEGFKDFQFLNRKQKETIFNSLFKEKRKVTEKDIISFLNKVDGYEGIAIKGIEKQFNASLSTYHDLKKILGKDFLDNTDNELILEDIVQTLTLFEDREMIRKRLDIYKDFFTESQLKKLYRRHYTGWGRLSAKLINGIRNKENQKTILDYLIDDGSANRNFMQLIKDAGLSFKPIIDKARTGSHSDNLKEVVGELAGSPAIKKGILQSLKIVDELVKVMGYEPEQIVVEMARENQTTAKGLSRSRQRLTTLRESLANLKSEKKPKYVKDQVENHHLSDDRLFLYYLQNGKDMYTDDELDIDNLSQYDIDHIIPQAFIKDDSIDNRVLVSSAKNRGKSDDVPSVEIVKDCKVFWKKLLDAKLMSQRKYDNLTKAERGGLTSDDKARFIQRQLVETRQITKHVARILDERFNNELDSKGRRIRKVKIVTLKSNLVSNFRKEFGFYKIREVNNYHHAHDAYLNAVVAKAILTKYPQLEPEFVYGDYPKYNSYKTRKATEKLFFYSNIMNFFKTKVTLADGTVVVKDDIEVNNDTGEIVWDKKKHFATVRKVLSYPQVNIVKKTEIQTGGFSKESILAHGNSDKLIPRKTKDIYLDPKKYGGFDSPIVAYSVLVVADIKKGKAQKLKTVTELLGITIMERSRFEKNPSAFLESKGYLNIRDDKLMILPKYSLFELENGRRRLLASAGELQKGNELALPTQFMKFLYLASRYNELKGKPEEIEQKQEFVVQHVSYFDDILQIINDFSNRVILADANLEKINKLYQDNKENIPVDELANNIINLFTFTSLGAPAAFKFFDKIVDRKRYTSTKEVLNSTLIHKSITGLYETRIDLGKLGED

SEQ ID NO: 85 - protein, 1365 aa, Streptococcus agalactiae
MNKPYSIGLDIGTNSVGWSIITDDYKVPAKKMRVLGNTDKEYIKKNLIGALLFDGGNTAADRRLKRTARRRYTRRRNRILYLQEIFAEEMSKVDDSFFHRLEDSFLVEEDKRGSKYPIFATLQEEKDYHEKFSTIYHLRKELADKKEKADLRLIYIALAHIIKFRGHFLIEDDSFDVRNTDISKQYQDFLEIFNTTFENNDLLSQNVDVEAILTDKISKSAKKDRILAQYPNQKSTGIFAEFLKLIVGNQADFKKYFNLEDKTPLQFAKDSYDEDLENLLGQIGDEFADLFSAAKKLYDSVLLSGILTVIDLSTKAPLSASMIQRYDEHREDLKQLKQFVKASLPEKYQEIFADSSKDGYAGYIEGKTNQEAFYKYLSKLLTKQEDSENFLEKIKNEDFLRKQRTFDNGSIPHQVHLTELKAIIRRQSEYYPFLKENQDRIEKILTFRIPYYIGPLAREKSDFAWMTRKTDDSIRPWNFEDLVDKEKSAEAFIHRMTNNDFYLPEEKVLPKHSLIYEKFTVYNELTKVRYKNEQGETYFFDSNIKQEIFDGVFKEHRKVSKKKLLDFLAKEYEEFRIVDVIGLDKENKAFNASLGTYHDLEKILDKDFLDNPDNESILEDIVQTLTLFEDREMIKKRLENYKDLFTESQLKKLYRRHYTGWGRLSAKLINGIRDKESQKTILDYLIDDGRSNRNFMQLINDDGLSFKSIISKAQAGSHSDNLKEVVGELAGSPAIKKGILQSLKIVDELVKVMGYEPEQIVVEMARENQTTNQGRRNSRQRYKLLDDGVKNLASNILKEYPTDNQALQNERLFLYYLQNGRDMYTGEALDIDNLSQYDIDHIIPQAFIKDDSIDNRVLVSSAKNRGKSDDVPSLEIVKDCKVFWKKLLDAKLMSQRKYDNLTKAERGGLTSDDKARFIQRQLVETRQITKHVARILDERFNNELDSKGRRIRKVKIVTLKSNLVSNFRKEFGFYKIREVNNYHHAHDAYLNAVVAKAILTKYPQLEPEFVYGDYPKYNSYKTRKATEKLFFYSNIMNFFKTKVTLADGTVVIKDDIEVNNDTGEIVWDKKKHFATVRKVLSYPQNNIVKKTEIQTGGFSKESILAHGNSDKLIPRKTKDIYLDPKKYGGFDSPIVAYSVLVVADIKKGKAQKLKTVTELLGITIMERSRFEKNPSAFLESKGYLNIRADKLIILPKYSLFELENGRRRLLASAGELQKGNELALPTQFMKFLYLASRYNESKGKPEEIEKKQEFVNQHVSYFDDILQLINDFSKRVILADANLEKINKLYQDNKENISVDELANNIINLFTFTSLGAPAAFKFFDKIVDRKRYTSTKEVLNSTLIHQSITGLYETRIDLGKLGED

SEQ ID NO: 86 - protein, 1365 aa, Streptococcus agalactiae
MNKPYSIGLDIGTNSVGWSIITDDYKVPAKKMRVLGNTDKEYIKKNLIGALLFDGGNTAADRRLKRTARRRYTRRRNRILYLQEIFAEEMSKVDDSFFHRLEDSFLVEEDKRGSKYPIFATLQEEKDYHEKFSTIYHLRKELADKKEKADLRLIYIALAHIIKFRGHFLIEDDSFDVRNTDISKQYQDFLEIFNTTFENNDLLSQNVDVEAILTDKISKSAKKDRILAQYPNQKSTGIFAEFLKLIVGNQADFKKYFNLEDKTPLQFAKDSYDEDLENLLGQIGDEFADLFSAAKKLYDSVLLSGILTVIDLSTKAPLSASMIQRYDEHREDLKQLKQFVKASLPEKYQEIFADSSKDGYAGYIEGKTNQEAFYKYLSKLLTKQEDSENFLEKIKNEDFLRKQRTFDNGSIPHQVHLTELKAIIRRQSEYYPFLKENQDRIEKILTFRIPYYIGPLAREKSDFAWMTRKTDDSIRPWNFEDLVDKEKSAEAFIHRMTNNDFYLPEEKVLPKHSLIYEKFTVYNELTKVRYKNEQGETYFFDSNIKQEIFDGVFKEHRKVSKKKLLDFLAKEYEEFRIVDVIGLDKENKAFNASLGTYHDLEKILDKDFLDNPDNESILEDIVQTLTLFEDREMIKKRLENYKDLFTESQLKKLYRRHYTGWGRLSAKLINGIRDKESQKTILDYLIDDGRSNRNFMQLINDDGLSFKSIISKAQAGSHSDNLKEVVGELAGSPAIKKGILQSLKIVDELVKVMGYEPEQIVVEMARENQTTNQGRRNSRQRYKLLDDGVKNLASNILKEYPTDNQALQNERLFLYYLQNGRDMYTGEALDIDNLSQYDIDHIIPQAFIKDDSIDNRVLVSSAKNRGKSDDVPSLEIVKDCKVFWKKLLDAKLMSQRKYDNLTKAERGGLTSDDKARFIQRQLVETRQITKHVASILDERFNNELDSKGRRIRKVKIVTLKSNLVSNFRKEFGFYKIREVNNYHHAHDAYLNAVVAKAILTKYPQLEPEFVYGDYPKYNSYKTRKATEKLFFYSNIMNFFKTKVTLADGTVVVKDDIEVNNDTGEIVWDKKKHFATVRKVLSYPQNNIVKKTEIQTGGFSKESILAHGNSDKLIPRKTKDIYLDPKKYGGFDSPIVAYSVLVVADIKKGKAQKLKTVTELLGITIMERSRFEKNPSAFLESKGYLNIRADKLIILPKYSLFELENGRRRLLASAGELQKGNELALPTQFMKFLYLASRYNESKGKPEEIEKKQEFVNQHVSYFDDILQLINDFSKRVILADANLEKINKLYQDNKENISVDELANNIINLFTFTSLGAPAAFKFFDKIVDRKRYTSTKEVLNSTLIHQSITGLYETRIDLGKLGED

SEQ ID NO: 87 - protein, 1365 aa, Streptococcus agalactiae
MNKPYSIGLDIGTNSVGYSVVTDDYKVPAKKMRVLGNTDKEYIKKNLIGALLFDGGNTASDRRLKRTARRRYTRRRNRILYLQEIFAEEMSKVDDSFFHRLEDSFLVEDDKRGSKYPIFATMQEEKDYHEKFPTIYHLRKELADKKEKANLRLVYLALAHIIKFRGHFLIEDDSFDVRNTDIQRQYQAFLEIFDTTFENNHLLSQNIDVEGILTDKISKSAKKDRILAQYPNQKSTGIFAEFLKLIVGNQADFKKHFNLEDKTPLQFAKDSYDEDLENLLGQIGDEFADLFSVAKKLYDSVLLSGILTVTDLSTKAPLSASMIQRYDEHREDLKQLKQFVKASLPEKYQEIFTDSSKDGYAGYIESKTNQGAFYKYLSKLLTKQEGSEYFLEKIKNEDFLRKQRTFDNGSIPHQVHLTELKAIIRRQSEYYPFLKENLDRIEKILTFRIPYYVGPLAREKSDFAWMTRKTDDSIRPWNFEELVDKEASAEAFIHRMTNNDLYLPEEKVLPKHSLIYEKFTVYNELTKVRYKNEQGETYFFDSNIKQEIFDGVFKEHRKVSKKKLLDFLAKEYEEFRIVDVIGLDKENKAFNASLGTYHDLKKILDKDFLDNPDNESILEDIVQTLTLFEDREMIKKRLENYKDLFTESQLKKLYRRHYTGWGRLSAKLINGIRDKESQKTILDYLISDGRANRNFMQLIHDDGLSFKPIIDKAQAGSHSDNLKEVVGELAGSPAIKKGILQSLKIVDELVKVMGYEPEQVVVEMARENQTTNQGRRNTRQRYKLLEEGVKNLASNILKEYPTDNQALQNERLFLYYLQNGRDMYTGEALDIDNLSQYDIDHIVPQAFIKDDSIDNRVLVSSAKNRGKSDNVPSIDIVKARKAFWKKLLDAKLMSQRKYDNLTKAERGGLTSDDKARFIQRQLVETRQITKHVARILDERFNNELDSKGRRIRKVKIVTLKSNLVSNFRKEFGFYKIREVNDYHHAHDAYLNAVVAKAILTKYPQLEPEFVYGDYPKYNSYKTRKATEKLFFYSNIMNFFKTKVTLADGTVVVKDDIEVNNDTGEIVWDKKKHFATVRKVLSYPQVNIVKKTEIQTGGFSKESILAHGNSDKLIPRKTKDIYLDPKKYGGFDSPIVAYSVLVVADIKKGKAQKLKTVTELLGITIMERFRFEKNPSAFLESKGYLNIRDDKLMILPKYSLFELENGRRRLLASAGELQKGNELALPTQYMKFLYLASRYNELKGKPEEIEQKQEFVVQHVSYFDDILQIINDFSNRVILADANLEKINKLYQDNKENISVDELANNIINLFTFTSLGAPAAFKFFDKIVDRKRYTSTKEVLNSTLIHQSITGLYETRIDLGKLGED

SEQ ID NO: 88 - protein, 1365 aa, Streptococcus agalactiae
MNKPYSIGLDIGTNSVGWSIITDDYKVPAKKMRVLGNTDKEYIKKNLIGALLFDGGNTAADRRLKRTARRRYTRRRNRILYLQEIFAEEMSKVDDSFFHRLEDSFLVEEDKRGSKYPIFATLQEEKDYHEKFSTIYHLRKELADKKEKADLRLIYIALAHIIKFRGHFLIEDDSFDVRNTDISKQYQDFLEIFNTTFENNDLLSQNVDVEAILTDKISKSAKKDRILAQYPNQKSTGIFAEFLKLIVGNQADFKKYFNLEDKTPLQFAKDSYDEDLENLLGQIGDEFADLFSAAKKLYDSVLLSGILTVIDLSTKAPLSASMIQRYDEHREDLKQLKQFVKASLPEKYQEIFADSSKDGYAGYIEGKTNQEAFYKYLSKLLTKQEDSENFLEKIKNEDFLRKQRTFDNGSIPHQVHLTELKAIIRRQSEYYPFLKENQDRIEKILTFRIPYYIGPLAREKSDFAWMTRKTDDSIRPWNFEDLVDKEKSAEAFIHRMTNNDFYLPEEKVLPKHSLIYEKFTVYNELTKVRYKNEQGETYFFDSNIKQEIFDGVFKEHRKVSKKKLLDFLAKEYEEFRIVDVIGLDKENKAFNASLGTYHDLEKILDKDFLDNPDNESILEDIVQTLTLFEDREMIKKRLENYKDLFTESQLKKLYRRHYTGWGRLSAKLINGIRDKESQKTILDYLIDDGRSNRNFMQLINDDGLSFKSIISKAQAGSHSDNLKEVVGELAGSPAIKKGILQSLKIVDELVKVMGYEPEQIVVEMARENQTTNQGRRNSRQRYKLLDDGVKNLASNILKEYPTDNQALQNERLFLYYLQNGRDMYTGEALDIDNLSQYDIDHIIPQAFIKDDSIDNRVLVSSAKNRGKSDDVPSLEIVKDCKVFWKKLLDAKLMSQRKYDNLTKAERGGLTSDDKARFIQRQLVETRQITKHVARILDERFNNELDSKGRRIRKVKIVTLKSNLVSNFRKEFGFYKIREVNNYHHAHDAYLNAVVAKAILTKYPQLEPEFVYGDYPKYNSYKTRKATEKLFFYSNIMNFFKTKVTLADGTVVVKDDIEVNNDTGEIVWDKKKHFATVRKVLSYPQNNIVKKTEIQTGGFSKESILAHGNSDKLIPRKTKDIYLDPKKYGGFDSPIVAYSVLVVADIKKGKAQKLKTVTELLGITIMERSRFEKNLSAFLESKGYLNIRADKLIILPKYSLFELENGRRRLLASAGELQKGNELALPTQFMKFLYLASRYNESKGKPEEIEKKQEFVNQHVSYFDDILQLINDFSKRVILADANLEKINKLYQDNKENISVDELANNIINLFTFTSLGAPAAFKFFDKIIDRKRYTSTKEVLNSTLIHQSITGLYETRIDLGKLGED

SEQ ID NO: 89 - protein, 1365 aa, Streptococcus agalactiae
MNKPYSIGLDIGTNSVGWSIITDDYKVPAKKMRVLGNTDKEYIKKNLIGALLFDGGNTAADRRLKRTARRRYTRRRNRILYLQEIFAEEMSKVDDSFFHRLEDSFLVEEDKRGSKYPIFATLQEEKDYHEKFSTIYHLRKELADKKEKADLRLIYIALAHIIKFRGHFLIEDDSFDVRNTDISKQYQDFLEIFNTTFENNDLLSQNVDVEAILTDKISKSAKKDRILAQYPNQKSTGIFAEFLKLIVGNQADFKKYFNLEDKTPLQFAKDSYDEDLENLLGQIGDEFADLFSAAKKLYDSVLLSGILTVIDLSTKAPLSASMIQRYDEHREDLKQLKQFVKASLPEKYQEIFADSSKDGYAGYIEGKTNQEAFYKYLSKLLTKQEDSENFLEKIKNEDFLRKQRTFDNGSIPHQVHLTELKDIIRRQSEYYPFLKENQDRIEKILTFRIPYYIGPLAREKSDFAWMTRKTDDSIRPWNFEDLVDKEKSAEAFIHRMTNNDFYLPEEKVLPKHSLIYEKFTVYNELTKVRYKNEQGETYFFDSNIKQEIFDGVFKEHRKVSKKKLLDFLAKEYEEFRIVDVIGLDKENKAFNASLGTYHDLEKILDKDFLDNPDNESILEDIVQTLTLFEDREMIKKRLENYKDLFTESQLKKLYRRHYTGWGRLSAKLINGIRDKESQKTILDYLIDDGRSNRNFMQLINDDGLSFKSIISKAQAGSHSDNLKEVVGELAGSPAIKKGILQSLKIVDELVKVMGYEPEQIVVEMARENQTTNQGRRNSRQRYKLLDDGVKNLASNILKEYPTDNQALQNERLFLYYLQNGRDMYTGEALDIDNLSQYDIDHIIPQAFIKDDSIDNRVLVSSAKNRGKSDDVPSLEIVKDCKVFWKKLLDAKLMSQRKYDNLTKAERGGLTSDDKARFIQRQLVETRQITKHVARILDERFNNELDSKGRRIRKVKIVTLKSNLVSNFRKEFGFYKIREVNNYHHAHDAYLNAVVAKAILTKYPQLEPEFVYGDYPKYNSYKTRKATEKLFFYSNIMNFFKTKVTLADGTVVVKDDIEVNNDTGEIVWDKKKHFATVRKVLSYPQNNIVKKTEIQTGGFSKESILAHGNSDKLIPRKTKDIYLDPKKYGGFDSPIVAYSVLVVADIKKGKAQKLKTVTELLGITIMERSRFEKNPSAFLESKGYLNIRADKLIILPKYSLFELENGRRRLLASAGELQKGNELALPTQFMKFLYLASRYNESKGKPEEIEKKQEFVNQHVSYFDDILQLINDFSKRVILADANLEKINKLYQDNKENISVDELANNIINLFTFTSLGAPAAFKFFDKIVDRKRYTSTKEVLNSTLIHQSITGLYETRIDLGKLGED

SEQ ID NO: 90 - protein, 1365 aa, Streptococcus agalactiae
MNKPYSIGLDIGTNSVGWSIITDDYKVPAKKMRVLGNTDKEYIKKNLIGALLFDGGNTAADRRLKRTARRRYTRRRNRILYLQEIFAEEMSKVDDSFFHRLEDSFLVEEDKRGSKYPIFATMQEEKDYHEKFPTIYHLRKELADKKEKADLRLVYLALAHIIKFRGHFLIEDDRFDVRNTDIQKQYQAFLEIFDTSFENNHLLSQNVDVEAILTDKISKSAKKDRILAQYPNQKSTGIFAEFLKLIVGNQADFKKHFNLEDKTPLQFAKDSYDEDLENLLGQIGDEFADLFSAAKKLYDSVLLSGILTVTDLSTKAPLSASMIQRYDEHREDLKQLKQFVKASLPEKYQEIFADSSKDGYAGYIEGKTNQEAFYKYLSKLLTKQEDSEYFLEKIKNEDFLRKQRTFDNGSIPHQVHLTELKAIIRRQSEYYPFLKENQDKIEKILTFRIPYYVGPLARGNSDFAWMTRKTDDSIRPWNFEDLVDKEKSAEAFIHRMTNNDLYLPEEKVLPKHSLIYEKFTVYNELTKVRYKNEQGETYFFDSNVKQEIFDGVFKEHRKVSKKQLLDFLAKEFEEFRIVDVTGLDKENKAFNASLGTYHDLKKILDKDFLDNPDNESILEDIVQTITLFEDREMIKKRLENYKDLFTESQLKKLYRRHYTGWGRLSAKLINGIRDRESQKIILDYLISDGRANRNFMQLINDDGLSFKSIISKAQSGSHSDNLKEVVGELAGSPAIKKGILQSLKIVDELVKVMGYEPEQIVVEMARENQTTNQGRRNSRQRYKLLEDGVKNLASDILKEYPTDNQALQNERLFLYYLQNGRDMYTGEALDIDSLSQYDIDHIVPQAFIKDDSIDNRVLVSSAKNRGKSDDVPSIDIVKARKAFWKKLLDAKLISQRKYDNLTKAERGGLTPDDKAGFIQRQLVETRQITKHVARILDERFNNKVDDNNKPIRKVKIVTLKSNLVSNFRKEFGFYKIREVNNYHHAHDAYLNAVVAKAILTKYPQLEPEFVYGDYPKYNSYKTRKATEKLFFYSNIMNFFKTKVTLADETVVVKDDIEVNNETGEIAWDKKKHFATVRKVLSYPQVNIVKKTEVQTGGFSKESILAHSNSDKLIPRKTKDIYLDPKKYGGFDSPIVAYSVLVLADIKKGKAQKLKTVKELIGITIMERERFEKNPSAFLESKGYLNIRTDKLIILPKYSLFELENGRRRLLASAGELQKGNELALPTQYMKFLYLASRYNESKGKPEEIEKKQEFVNQHVSYFDDILQLINDFSKRVILADANLEKINKLYSDNKDNTPVDELAKNIINLFTFTSLGAPAAFKFFDKSVDRKRYTSTKEVLDSTLIHQSITGLYETRIDLGKLGED

SEQ ID NO: 91 - protein, 1365 aa, Streptococcus agalactiae
  misc_feature (9)..(9): Xaa can be any naturally occurring amino acid
MNKPYSIGXDIGTNSVGWSIITDDYKVPAKKMRVLGNTDKEYIKKNLIGALLFDGGNTAADRRLKRTARRRYTRRRNRILYLQEIFAEEMSKVDDSFFHRLEDSFLVEEDKRGSKYPIFATLQEEKDYHEKFSTIYHLRKELADKKEKADLRLIYIALAHIIKFRGHFLIEDDSFDVRNTDISKQYQDFLEIFNTTFENNDLLSQNVDVEAILTDKISKSAKKDRILAQYPNQKSTGIFAEFLKLIVGNQADFKKYFNLEDKTPLQFAKDSYDEDLENLLGQIGDEFADLFSAAKKLYDSVLLSGILTVIDLSTKAPLSASMIQRYDEHREDLKQLKQFVKASLPEKYQEIFADSSKDGYAGYIEGKTNQEAFYKYLSKLLTKQEDSENFLEKIKNEDFLRKQRTFDNGSIPHQVHLTELKAIIRRQSEYYPFLKENQDRIEKILTFRIPYYIGPLAREKSDFAWMTRKTDDSIRPWNFEDLVDKEKSAEAFIHRMTNNDFYLPEEKVLPKHSLIYEKFTVYNELTKVRYKNEQGETYFFDSNIKQEIFDGVFKEHRKVSKKKLLDFLAKEYEEFRIVDVIGLDKENKAFNASLGTYHDLEKILDKDFLDNPDNESILEDIVQTLTLFEDREMIKKRLENYKDLFTESQLKKLYRRHYTGWGRLSAKLINGIRDKESQKTILDYLIDDGRSNRNFMQLINDDGLSFKSIISKAQAGSHSDNLKEVVGELAGSPAIKKGILQSLKIVDELVKVMGYEPEQIVVEMARENQTTNQGRRNSRQRYKLLDDGVKNLASNILKEYPTDNQALQNERLFLYYLQNGRDMYTGEALDIDNLSQYDIDHIIPQAFIKDDSIDNRVLVSSAKNRGKSDDVPSLEIVKDCKVFWKKLLDAKLMSQRKYDNLTKAERGGLTSDDKARFIQRQLVETRQITKHVARILDERFNNELDSKGRRIRKVKIVTLKSNLVSNFRKEFGFYKIREVNNYHHAHDAYLNAVVAKAILTKYPQLEPEFVYGDYPKYNSYKTRKATEKLFFYSNIMNFFKTKVTLADGTVVVKDDIEVNNDTGEIVWDKKKHFATVRKVLSYPQNNIVKKTEIQTGGFSKESILAHGNSDKLIPRKTKDIYLDPKKYGGFDSPIVAYSVLVVADIKKGKAQKLKTVTELLGITIMERSRFEKNPSAFLESKGYLNIRADKLIILPKYSLFELENGRRRLLASAGELQKGNELALPTQFMKFLYLASRYNESKGKPEEIEKKQEFVNQHVSYFDDILQLINDFSKRVILADANLEKINKLYQDNKENISVDELANNIINLFTFTSLGAPAAFKFFDKIVDRKRYTSTKEVLNSTLIHQSITGLYETRIDLGKLGED

SEQ ID NO: 92 - protein, 1365 aa, Streptococcus agalactiae
MNKPYSIGLDIGTNSVGWSIITDDYKVPAKKMRVLGNTDKEYIKKNLIGALLFDGGNTAADRRLKRIARRRYTRRRNRILYLQEIFAEKMSKVDDSFFHRLEDSFLVEEDKRGSKYPIFATLQEEKDYHEKFPTIYHLRKELADKKEKADLRLVYLALAHIIKFRGHFLIEDDRFDVRNTDIQKQYQAFLEIFDTTFENNHLLSQNVDVEAILTDKISKSAKKDRILAQYPDQKSTGIFAEFLKLIVGNQADFKKHFNLEDKTPLQFAKDSYDEDLENLLGQIGDEFADLFSAAKKLYDSVLLSGILTVTDLSTKAPLSASMIQRYDEHREDLKQLKQFVKASLPEKYQEIFADSSKDGYAGYIEGKTNQEAFYKYLSKLLTKQEGSEYLLEKIKNEDFLRKQRTFDNGSIPHQVHLTELRAIIRRQSEYYPFLKENLDRIEKILTFRIPYYVGPLAREKSDFAWMTRKTDDSIRPWNFEELVDKEASAEAFIHCMTNNDLYLPEEKVLPKHSLIYEKFTVYNELTKVRYKNEQGETYFFDSNIKQEIFDGVFKEYRKVSKKQLLDFLAKEFEEFRIVDVTGLDKENKAFNASLGTYHDLEKILGKDFLDNPDNESILEDIVQTLTLFEDREMIKKRLDIYKDFFTESQLKKLYRRHYTGWGRLSAKLINGIRNKENQKTILDYLIDDGSANRNFMQLIKDAGLSFKSIISKAQSGSHSDNLKEVVSELAGSPAIKKGILQSLKIVDELVKVMGYKPEQIVVEMARENQTTNQGRRNSRQRYKLLDDGVRNLASNILKEYPTDNQALQNERLFLYYLQNGRDMYTEKALDIDNLSQYDIDHIIPQAFIKDDSIDNRVLVSSAKNRGKSDDVPSLEIVKDCKVFWKKLLDAKLMSQRKYDNLTKAERGGLTSDDKARFIQRQLVETRQITKHVARILDERFNNELDSKGRRIRKVKIVTLKSNLVSNFRKEFGFYKIREVNDYHHAHDAYLNAVVAKAILTKYPQLEPEFVYGDYPKYNSYKTRKATEKLFFYSNIMNFFKTKVTLADGTVVVKDDIEVNNDTGEIVWDKKKHFATVRKVLSYPQNNIVKKTEIQTGGFSKESILAHGNSDKLIPRKTKDIYLDPKKYGGFDSPIVAYSVLVVADIKKGKAQKLKTVTELLGITIMERSRFEKNPSAFLESKGYLNIRTDKLIILPKYSLFELENGRRRLLASAGELQKGNELALPTQFMKFLYLASRYNESKGKPEEIEKKQEFVNQHVSYFDDILQIINDFSNRVILADANLEKINKLYQDNKENISVDELANNIINLFTFTSLGAPAAFKFFDKIVDRKRYTSTKEVLNSTLIHQSITGLYETRIDLGKLGED

SEQ ID NO: 93 - protein, 1351 aa, Streptococcus anginosus
MNQKYSIGLDIGTNSVGWAVITDDYKVPAKKMKVLGNTDKQSIKKNLLGALLFDSGETAEATRLKRTARRRYTRRRNRLRYLQEIFAEEMMQVDESFFQRLDDSFLVDEDKRGERHPIFGNIAAEVKYHDEFPTIYHLRKHLADISQKADLRLVYLALAHMIKFRGHFLIEGQLKAENTNVQALFKDFVEVYDKTVEESHLSEITVDALSILTEKVSKSRRLENLIAHYPAEKKNTLFGNLIALFLGLQPNFKTNFQLSEDAKLQFSKDTYEEDLEGLLGEVGDEYADLFASAKNLYDAILLSGILTVDDNSTKAPLSASMVKRYEEHQKDLKKFEDFIKVNALDQYNAIFKDKNKKGYAGYIESGVKQDEFYKYLKGILLQINGSGDFLDKIDREDFLRKQRTFDNGSIPHQIHLQEMHAILRRQGEHYPFLKENQDKIEKILTFRIPYYVGPLARKGSRFAWAEYKADEKITPWNFDDILDKEKSAEKFITRMTLNDLYLPEEKVLPKHSLLYETFTVYNELTKVKYVNEQGEAKFFDANMKQEIFDHVFKENRKVTKDKLLNYLNKEFEEFRIVNLTGLDKENKVFNSSLGTYHDLRKILNKSFLDNKENAQIIEDIIQTLTLFEDREMIRQRLQKYSDIFTKAQLKKLERRHYTGWGRLSYKLINGIRNKENKKTILDYLIDDGYANRNFMQLINDDALSFKEEIAKAQIIGDVDDIANVVHDLPGSPAIKKGILQSVKIVDELVKVMGHNPANIIIEMARENQTTDRGRRNSQQRLKLLQDSLKPVNIKNVENQQLQNDRLFLYYIQNGKDMYTGETLDINNLSQYDIDHIIPQAYIKDDSFDNRVLTSSSENRGKSDNVPSIEVVCARKADWMRLRKAGLISQRKFDNLTKAERGGLTENDKAGFIKRQLVETRQITKHVAQVLDARFNAKHDENKKVIRDVKIITLKSNLVSQFRKDFKFYKVREINDYHHAHDAYLNAVIGTALLKKYPKLASEFVYGEFKKYDVSDKEIGKATAKYFFYSNLMNFFKKEVKFADGTVVERPDIETSEDGEIAWNKQTDFKIVRKVLSYPQVNIVKKTEVQTHGLDRPSPKPKPDSSENLVGVKRNLDPKKYGGYAGISNSYAVLVKAIIEKGVKKKETMVLEFQGISILDRITFEKDKRAFLLGKGYKDIKKIIELPKYSLFELKDGSRRMLASRGEIHKGNELFVPQKFTTLLYHAKRINNPINKDHIEYVKKHRDDFKELLNYVLEFNEKYVGATKNGERLKEAVADFDSKSNEEICTSFLGLFELTSLGSASDFEFLGVKIPRYRDYTPSSLLKDSTLIHQSITGLYETRIDLSKLGED

SEQ ID NO: 94 - protein, 1341 aa, Streptococcus anginosus
MKKEYSIGLDIGTNSVGWAVITDDYKVPAKKMKVLGNTDKQSIKKNLLGALLFDSGETAEATRLKRTARRRYTRRKNRLRYLQEIFTEEMNKVDENFFQRLDDSFLVEEDKQGSKYPIFGTLKEEKEYHKKFKTIYHLREELANSKEKADLRLVYLALAHMIKFRGHFLYEGDLKAENTDVQALFKDFVEEYDKTIEESHLSEITVDALSILTEKVSKSSRLENLIAHYPTEKKNTLFGNLIALSLGLQPNFKTNFQLSEDAKLQFSKDTYEEDLEELLGEIGDEYADLFASAKNLYDAILLSGILAVDDNTTKAPLSASMVKRYEEHQKDLKKLKDFIKVNAPDQYNAIFKDKNKKGYAGYIESGVEQDEFYKYLKGILLKINGSGDFLDKIDCEDFLRKQRTFDNGSIPHQIHLQEMHAILRRQGEHYPFLKENQDKIEKILTFRIPYYVGPLARKGSRFAWAEYKADEKITPWNFDDILDKEKSAEKFITRMTLNDLYLPEEKVLPKHSPLYETFTVYNELTKVKYVNEQGEAKFFDTNMKQEIFDHVFKENRKVTKDKLLNYLNKEFEEFRIVNLTGLDKENKAFNSSLGTYHDLRKILDKSFLDDKANEKTIEDIIQTLTLFEDREMIRQRLQKYSDIFTKAQLKKLERRHYTGWGRLSYKLINGIRNKENKKTILDYLIDDGYANRNFMQLINDDALSFKEEIARAQIIGDVDDIANVVHDLPGSPAIKKGILQSVKIVDELVKVMGHNPANIIIEMARENQTTDKGRRNSQQRLKLLQDSLKPVNIKNVENQQLQNDRLFLYYIQNGKDMYTGETLDINNLSQYDIDHIIPQAFIKDNSLDNRVLTRSDKNRGKSDDVPSIEVVHEMKSFWSKLLSVKLITQRKFDNLTKAERGGLTEEDKAGFIKRQLVETRQITKHVAQILDERFNTEFDGAQRRIRNVKIITLKSNLVSNFRKEFELYKVREINDYHHAHDAYLNAVVGNALLLKYPQLEPEFVYGEYPKYNSYRSRKSATEKFLFYSNILRFFKKEDIQTNEDGEIAWNKEKHIKILRKVLSYPQVNIVKKTEEQTGGFSKESILPKGESDKLIPRKTKNSYWNPKKYGGFDSPVVAYSILVFADVEKGKSKKLRKVQDMVGITIMEKKRFEKNPVDFLEQRGYRNVRLEKIIKLPKYSLFELENKRRRLLASARELQKGNELVIPQRFTTLLYHSYQIEKNYEPEHREYVEKHKDEFKELLEYISVFSRKYVLADNNLTKIEMLFSKNKDAEVSSLAKSFISLLTFTAFGAPAAFNFFGENIDRKRYTSVTECLNATLIHQSITGLYETRIDLSKLGED

SEQ ID NO: 95 - protein, 1341 aa, Streptococcus anginosus
MKKEYSIGLDIGTNSVGWAVITDDYKVPAKKMKVLGNTDKQSIKKNLLGALLFDSGETAEATRLKRTARRRYTRRRNRLRYLQEIFAEEMMQVDESFFQRLDDSFLVEEDKRGSRYPIFGNIAAEVKYHDDFPTIYHLRKHLVDISQKADLRLVYLALAHMIKFRGHFLIEGQLKAENTNVQALFKDFVEVYDKTVEESHLSEMTVDALSILTEKVSKSRRLENLVECYPTEKKNTLFGNLIALSLGLQPNFKTNFQLSEDAKLQFSKDTYEEDLEGLLGEIGDEYADLFASAKNLYDAILLSGILAVDDNTTKAPLSASMVKRYEEHQKDLKKLKDFIKVNAPAQYDDIFKDETKNGYAGYIENGVKQDEFYKYLKNTLSKIDGSDYFLDKIDREDFLRKQRTFDNGSIPHQIHLQEMHAILRRQGEHYPFLKENQDKIEKILTFRIPYYVGPLARKGSRFAWAEYKADEKITPWNFDDILDKEKSAEKFITRMTLNDLYLPEEKVLPKHSPLYETFTVYNELTKVKYVNEQGEAKFFDTNMKQEIFDHVFKENRKVTKDKLLNYLNKEFEEFRIVNLTGLDKENKAFNASLGTYHDLRKILDKSFLDDKVNEKIIEDIIQTLTLFEDREMIRQRLQKYSDIFTTQQLKKLERRHYTGWGRLSYKLINGIRNKENKKTILDYLIDDGYANRNFMQLINDDALSFKEEIARAQIIGDVDDIANVVHDLPGSPAIKKGILQSVKIVDELVKVMGHNPANIIIEMARENQTTDKGRRNSQQRLKLLQDSLKPVNIKNVENQQLQNDRLFLYYIQNGKDMYTGETLDINNLSQYDIDHIIPQAFIKDNSLDNRVLTRSDKNRGKSDDVPSIEVVHEMKSFWSKLLSVKLITQRKFDNLTKAERGGLTEEDKAGFIKRQLVETRQITKHVAQILDERFNTEFDGAQRRIRNVKIITLKSNLVSNFRKEFELYKVREINDYHHAHDAYLNAVVGNALLLKYPQLEPEFVYGEYPKYNSYRSRKSATEKFLFYSNILRFFKKEDIQTNEDGEIAWNKEKHIKILRKVLSYPQVNIVKKTEEQTGGFSKESILPKGESDKLIPRKTKNSYWNPKKYGGFDSPVVAYSILVFADVEKGKSKKLRKVQDMVGITIMEKKRFEKHPVDFLEQRGYRNVRLEKIIKLPKYSLFELENKRRRLLASARELQKGNELVIPQRFTTLLYHSYRIEKDYEPEHREYVEKHKDEFKELLEYISVFSRKYVLADNNLTKIEMLFSKNKDAEVSSLAKSFISLLTFTAFGAPAAFNFFGENIDRKRYTSVTECLNATLIHQSITGLYETRIDLSKLGED

SEQ ID NO: 96 - protein, 1341 aa, Streptococcus anginosus; identical to SEQ ID NO: 94

SEQ ID NO: 97 - protein, 1360 aa, Streptococcus caballi
MTKKNYSIGLDIGTNSVGWAVITDDYKVPAKKMKVLGNTDKKYIKKNLLGALLFDSGETAEATRLKRTARRRYTRRKNRLRYLQDIFTEEMAKVDDSFFQRLDESFLTDNDKNFDSHPIFGNKAEEDAYHQKFPTIYHLRKHLADSTEKADLRLVYLALAHMIKFRGHFLIEGELNAENTDVQKLFTDFVGVYDRTFDDSHLSEITVDAASILTEKISKSRRLENLINNYPKEKKNTLFGNLIALALGLQPNFKTNFKLSEDAKLQFSKDTYEEDLEELLGKIGDDYADLFTSSKNLYDAILLSGILTVDDNSTKAPLSASMIKRYVEHHEDLEKLKEFIKANKSELYHDIFKDKTQNGYAGYIENGVKQDEFYKYLKGILTKINGSDYFLDKIEREDFLRKQRTFDNGSIPHQIHLQEMHAILRRQGDYYPFLKENQEEIEKILTFRIPYYVGPLARKDSRFAWAEYRSDEKITPWNFDKVIDKEKSAEKFITRMTLNDLYLPEEKVLPKHSHVYETFAVYNELTKVKYVNEQGKDSFFDSNMKQEIFDHVFKENRKVTKEKLLNYLDKEFPEYRIQDLVGLDKENKSFNASLGTYHDLKKILDKSFLDDKVNEEVIEDIIKTLTLFEDREMIQQRLQKYSDIFTKQQLKKLERRHYTGWGRLSYKLINGIRNKENNKTILDYLIDDGSANRNFMQLINDDALSFKQIIQEAQVVGDVDDIETVVHDLPGSPAIKKGILQSVKIVDELIKVMGDNPDNIVIEMARENQTTNRGRSQSQQRLKKLQNSLKPSYIEDKVENSHLQNDQLFLYYIQNGKDMYTGDELDIDHLSDYDIDHIIPQAFIKDDSIDNRVLTSSAKNRGKSDDVPSLGIVRARKAEWVRLYKSGLISKRKFDNLTKAERGGLTEADKAGFIKRQLVETRQITKHVAQILDARFNTERDENDKVIRDVKVITLKSNLVSQFRKEFKFYKVREINDYHHAHDAYLNAVVGTALLKKYPKLAPEFVYGEYKKYDVSSDDHSEMGKATAKYFFYSNLMNFFKRVIRYSNGKVIVRPVVEYSKDTGEIAWNKRTDFEKVRKVLSYPQVNIVKKVETQTGGFSKESILPKGDSDKLIPRKTKKVLWEPKKYGGFDSPTVAYSVLVVADVEKGKTKKLKTVKELVGISIMERSFFEKNPVEFLKNKGYQNVQEDKLMKLPKYSLFEFEGGRRRLLASATELQKGNEIMLSAHLVALLYHAHRIGNFNSAEHLKYVSEHKKEFEEVLSCVENFANVYVDVEKNLSKIRAAADSMDNFSIEEISDSFINLLTLTALGAPADFNFLGEKIPRKRYNSTKECLNATLIHQSITGLYETRIDLSKLGEE

SEQ ID NO: 98 - protein, 1355 aa, Streptococcus canis
MEKKYSIGLDIGTNSVGWAVITDDYKVPSKKFKVLGNTNRKSIKKNLMGALLFDSGETAEATRLKRTARRRYTRRKNRIRYLQEIFANEMAKLDDSFFQRLEESFLVEEDKKNERHPIFGNLADEVAYHRNYPTIYHLRKKLADSPEKADLRLIYLALAHIIKFRGHFLIEGKLNAENSDVAKLFYQLIQTYNQLFEESLDEIEVDAKGILSARLSKSKRLEKLIAVFPNEKKNGLFGNIIALALGLTPNFKSNFDLTEDAKLQLSKDTYDDDLDELLGQIGDQYADLFSAAKNLSDAILLSDILRSNSEVTKAPLSASMVKRYDEHHQDLALLKTLVRQQFPEKYAEIFKDDTKNGYAGYVGIGATQEEFYKFIKPILEKMDGAEELLAKLNRDDLLRKQRTFDNGSIPHQIHLKELHAILRRQEEFYPFLKENREKIEKILTFRIPYYVGPLARGNSRFAWLTRKSEEAITPWNFEEVVDKGASAQSFIERMTNFDEQLPNKKVLPKHSLLYEYFTVYNELTKVKYVTERMRKPEFLSGEQKKAIVDLLFKTNRKVTVKQLKEDYFKKIECFDSVEIIGVEDRFNASLGTYHDLLKIIKDKDFLDNEENEDILEDIVLTLTLFEDREMIEERLKTYAHLFDDKVMKQLKRRHYTGWGRLSRKMINGIRDKQSGKTILDFLKDGFSNRNFMQLIHDDSLTFKEEIEKAQVSGQGDSLHEQIADLAGSPAIKKGILQTVKIVDELVKVMGHKPENIVIEMARENQTTTKGLQQSRERKKRIEEGIKELESQILKENPVENTQLQNEKLYLYYLQNGRDMYVDQELDINRLSDYDVDHIVPQSFIKDDSIDNKVLTRSVENRGKSDNVPSEEVVKKMKNYWRQLLNAKLITQRKFDNLTKAERGGLSEADKAGFIKRQLVETRQITKHVARILDSRMNTKRDKNDKPIREVKVITLKSKLVSDFRKDFQLYKVRDINNYHHAHDAYLNAVVGTALIKKYPKLESEFVYGDYKVYDVSEQEIGKATAKRFFYSNIMNFFKTEVKLANGEIRKRPLIETNGETGEVVWNKEKDFATVRKVLAMPQVNIVKKTEVQTGGFSKESILSKRESAKLIPRKKGWDTRKYGGFGSPTVAYSILVVAKVEKGKAKKLKSVKVLVGITIMEKGSYEKDPIGFLEAKGYKDIKKELIFKLPKYSLFELENGRRRMLASELQKANELVLPQHLVRLLYYTQNISATTGSNNLGYIEQHREEFKEIFEKIIDFSEKYILKNKVNSNLKSSFDEQFAVSDSILLSNSFVSLLKYTSFGASGGFTFLDLDVKQGRLRYQTVTEVLDATLIYQSITGLYETRTDLSQLGGD

SEQ ID NO: 99 - protein, 1341 aa, Streptococcus constellatus
MGKPYSIGLDIGTNSVGWAVVTDDYKVPAKKMKVLGNTDKQSIKKNLLGALLFDSGETAEATRLKRTARRRYTRRKNRLRYLQEIFTGEMNKVDENFFQRLDDSFLVDEDKRGEHHPIFGNIAAEVKYHDDFPTIYHLRRHLADTSKKADLRLVYLALAHMIKFRGHFLYEGDLKAENTDVQALFKDFVEEYDKTIEESHLSEITVDALSILTEKVSKSSRLENLIAHYPTEKKNTLFGNLIALSLDLHPNFKTNFQLSEDAKLQFSKDTYEEDLEGFLGEVGDEYADLFASAKNLYDAILLSGILTVDDNSTKAPLSASMVKRYEEHQKDLKKLKDFIKVNAPDQYNAIFKDKNKKGYASYIESGVKQDEFYKYLKGILLKINGSGDFLDKIDREDFLRKQRTFDNGSIPHQIHLQEMHAILRRQGEHYPFLKENQDKIEKILTFRIPYYVGPLARKGSRFAWAEYKADEKITPWNFDDILDKEKSAEKFITRMTLNDLYLPEEKVLPKHSPLYEAFTVYNELTKVKYVNEQGEAKFFDTNMKQEIFDHVFKENRKVTKDKLLNYLNKEFEEFRIVNLTGLDKENKAFNSSLGTYHDLRKILDKSFLDDKANEKTIEDIIQTLTLFEDREMIRQRLQKYSDIFTKAQLKKLERRHYTGWGRLSYKLINGIRNKENKKTILDYLIDDGYANRNFMQLINDDALSFKEEIARAQIIDDVDDIANVVHDLPGSPAIKKGILQSVKIVDELVKVMGHNPANIIIEMARENQTTDKGRRNSQQRLKLLQDSLKPVNIKNVENQQLQNDRLFLYYIQNGKDMYTGETLDINNLSQYDIDHIIPQAFIKDNSLDNRVLTRSDKNRGKSDDVPSIEVVHEMKSFWSKLLSVKLITQRKFDNLTKAERGGLTEEDKAGFIKRQLVETRQITKHVAQILDERFNTEFDGNKRRIRNVKIITLKSNLVSNFRKEFELYKVREINDYHHAHDAYLNAVVGNALLLKYPQLEPEFVYGEYPKYNSYRSRKSATEKFLFYSNILRFFKKEDIQTNEDGEIAWNKEKHIKILRKVLSYPQVNIVKKTEEQTGGFSKESILPKGESDKLIPRKTKNSYWDPKKYGGFDSPVVAYSILVFADVEKGKSKKLRKVQDMVGITIMEKKRFEKNPVDFLEQRGYRNVRLEKIIKLPKYSLFELENKRRRLLASAKELQKGNELVIPQRFTTLLYHSYRIEKDYEPEHREYVEKHKDEFKELLEYISVFSRKYVLADNNLTKIEMLFSKNKDAEVSSLAKSFISLLTFTAFGAPAAFNFFGENIDRKRYTSVTECLNATLIHQSITGLYETRIDLSKLGED

SEQ ID NO: 100 - protein, 1355 aa, Streptococcus constellatus
MTQKYSIGLDIGTNSVGWAIVTDDYKVPAKKMKILGNTNKQYIKKNLLGALLFDSGETAKATRLKRTARRRYTRRKNRLRYLQEIFIEEMNKVDENFFQRLDDSFLVTEDKRGSKYPIFGTLKEEKEYYKEFETIYHLRKRLADSTGKVDLRLVYLALAHMIKFRGHFLIEGQLKAENTDVQTLFNDFVEVYDKTIEESHLAEITVDALSILTEKVSKSRRLENLVKCYPTEKKNTLFGNLIALSLGLQPNFKTNFQLSEDAKLQFSKDTYEEDLEELLGKIGDDYADLFTSAKNLYDTILLSGILAVDDNSTKALLSASMIKRYEEHQKDLKKLKDFIKVNAPAQYDDIFKDETKNGYAGYIENGVKQDEFYKYLKNTLSKIDGSGYFLDKIEREDFLRKQRTFDNGSIPHQIHLQEMHAILRRQGEHYPFLKENQDKIEKILTFRIPYYVGPLVRKGSRFAWAEYKADEKITPWNFDDILDKEKSAEKFITRMTLNDLYLPEEKVLPKHSLLYEIFTVYNELTKVKYVNEQGEAKFFDANMKQEIFDHVFKENPKVTKDKLLNYLDKEFDEFRIVDLTGLDKENKAFNASLGTYHDLRKILDKSFLDDKANEKTIEDIIQTLTLFEDREMIRQRLQKYSDIFTKAQLKKLERRHYTGWGRLSYKLINGIRNKENNKTILEYLVDDGYANRNFMQLINDDTLPFKQIIKDAQAIDDVDDIELIVHDLPGSPAIKKGILQSIKIVDELVKVMGYNPDNIVIEMARENQTTTKGRRNSQQRLKLLQDSLTPVSIKNVENQQLQNDRLFLYYIQNGKDMYTGEELDIHHLSDYDIDHIIPQAFIKDDSIDNRVLTSSAKNRGKSDNVPNLEVVCDRKADWIRLREAGLISQRKFDNLTKAERGGLTENDKAGFIHRQLVETRQITKHVAQILDARFNPKRDDNKKVIRDVKIITLKSNLVSQFRRDFKLYKVREINDYHHAHDAYLNAVVGTALLKKYPKLTSEFVYGEYKKYDVSDNDEIGKATAKYFFYSNLMNFFKTEVKFADGTVVERPDIETSEDGEIAWNKQTDFKIVRKVLSYPQVNIVKKVEKQTGRFSKESILPKGDSDKLIARKTKENYWDTKKYGGFDSPTVAYSVLVVADIKKGKAKKLKTVKELVGISIMERPFFEKNPIMFLESKGYRNIQKDKLIKLPKYSLFEFEGGRRRLLASAVELQKGNEMVLPQYLNNLLYHAHRIDNSDNSEHLKYITEHKEEFGKLLSYIENFAKSYVDVDKNLEKIQLAVEKIDSFSVKEISNSFIHLLTLTALGAPADFNFLGEKIPRKRYTSTKECLNATLIHQSITGLYETQTDLSKLGED

SEQ ID NO: 101 - protein, 1356 aa, Streptococcus dysgalactiae
MDKKYSIGLDIGTNSVGWAVITDDYKVPSKKFKVLGNTDRHSIKKNLIGALLFDSGETAEATRLKRTARRRYTRRKNRIRYLQEIFSSEMSKVDDSFFHRLEESFLVEEDKKHERHPIFGNIVDEVAYHEKYPTIYHLRKKLADSTDKADLRLIYLALAHMIKFRGHFLIEGDLNPDNSDMDKLFIQLVQTYNQLFEENINASRVDAKAILSARLSKSRRLENLIAQLPGEKRNGLFGNLIALSLGLTPNFKSNFDLAEDAKLQLSKDTYDDDLDNLLAQIGDQYADLFLAAKNLSDAILLSDILRVNSEITKAPLSASMIKRYDEHHQDLTLLKALVRQQLPEKYKEIFFDQSKNGYAGYIDGGASQEEFYKFIKPILEKMDGTEELLAKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPEFLSGKQKEAIVDLLFKTNRKVTVKQLKEDYFKKIECFDSVEISGVEDRFNASLGTYHDLLKIIKDKDFLDNEENEDILEDIVLTLTLFEDKEMIEERLKKYANLFDDKVMKQLKRRHYTGWGRLSRKLINGIRDKQSGKTILDFLKDGFANRNFMQLINDDSLTFKEAIQKAQVSGQGHSLHEQIANLAGSPAIKKGILQSVKVVDELVKVMGHKPENIVIEMARENQTTQKGQKNSRERMKRIEEGIKELGSQILKEHPVENTQLQNEKLYLYYLQNGRDMYVDQELDINRLSDYDVDHIVPQSFIKDDSIDNKILTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYTKLESEFVYGDYKVYDVSEQEIGKATAKRFFYSNIMNFFKTEITLANGEIRKRPLIETNEETGEIVWDKGRDFATVRKVLSMPQVNIVKKTEVQTGALTNESIYARGSFDKLISRKHRFESSKYGGFGSPTVTYSVLVVAKSKVQDGKVKKIKTGKELIGMTLLDKLVFEKNPLKFIEDKGYGNVQIDKCIKLPKYSLFEFENGTRRMLASRGDLQKANEMFLPAKLVTLLYHAHKIESSKELEHEAYILDHYNDLYQLLSYIERFASLYVDVEKNISKVKELFSNIESYSISEICSSVINLLTLTASGAPADFKFLGTTIPRKRYGSPQSILSSTLIHQSITGLYETRIDLSQLGGD

SEQ ID NO: 102 - protein, 1356 aa, Streptococcus dysgalactiae
MDKKYSIGLDIGTNSVGWAVITDDYKVPSKKFKVLGNTDRHSIKKNLIGALLFDSGETAEATRLKRTARRRYTRRKNRIRYLQEIFSSEMSKVDDSFFHRLEESFLVEEDKKHERHPIFGNIVDEVAYHEKYPTIYHLRKKLADSTDKADLRLIYLALAHMIKFRGHFLIEGDLNPDNSDVDKLFIQLVQTYNQLFEEKINASGVDAKAILSARLSKSKRLENLIAQLPGEKKNGLFGNLIALSLGLTPNFKSNFDLAEDAKLQLSKDTYDDDLDNLLAQIGNQYADLFLAAKNLSDAILLSDILRVNSEITKAPLSASMIKRYDEHHQDLTLLKALVRQQLPEKYKEIFFDQSKNGYAGYIDGGASQEEFYKFIKPILEKMDGTEELLAKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPEFLSGKQKEAIVDLLFKTNRKVTVKQLKEDYFKKIECFDSVEISGVEDRFNASLGTYHDLLKIIKDKDFLDNEENEDILEDIVLTLTLFEDKEMIEERLKKYANLFDDKVMKQLKRRHYTGWGRLSRKLINGIRDKQSGKTILDFLKDGFANRNFMQLINDDSLTFKEAIQKAQVSGQGHSLHEQIANLAGSPAIKKGILQSVKVVDELVKVMGHKPENIVIEMARENQTTQKGQKNSRERMKRIEEGIKELGSQILKEHPVENTQLQNEKLYLYYLQNGRDMYVDQELDINRLSDYDVDHIVPQSFIKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVSEQEIGKATAKRFFYSNIMNFFKTEITLANGEIRKRPLIETNEETGEIVWDKGRDFATVRKVLSMPQVNIVKKTEVQTGALTNESIYARGSFDKLISRKHRFESSKYGGFGSPTVTYSVLVVAKSKVQDGKVKKIKTGKELIGITLLDKLVFEKNPLKFIEDKGYGNVQIDKCIKLPKYSLFEFENGTRRMLASRGDLQKANEMFLPAKLVTLLYHAHKIESSKELEHEAYILDHYNDLYQLLSYIERFASLYVDVEKNISKVKELFSNIESYSISEICSSVINLLTLTASGAPADFKFLGTTIPRKRYGSPQSILSSTLIHQSITGLYETRIDLSQLGGD

SEQ ID NO: 103 - protein, 1356 aa, Streptococcus dysgalactiae
MDKKYSIGLDIGTNSVGWAVITDDYKVPSKKFKVLGNTDRHSIKKNLIGALLFDSGETAEATRLKRTARRRYTRRKNRIRYLQEIFSSEMSKVDDSFFHRLEESFLVEEDKKHERHPIFGNIVDEVAYHEKYPTIYHLRKKLADSTDKADLRLIYLALAHMIKFRGHFLIEGDLNPDNSDMDKLFIQLVQTYNQLFEENINASRVDAKAILSARLSKSRRLENLIAQLPGEKRNGLFGNLIALSLGLTPNFKSNFDLAEDAKLQLSKDTYDDDLDNLLAQIGDQYADLFLAAKNLSDAILLSDILRVNSEITKAPLSASMIKRYDEHHQDLTLLKALVRQQLPEKYKEIFFDQSKNGYAGYIDGGASQEEFYKFIKPILEKMDGTEELLAKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPEFLSGKQKEAIVDLLFKTNRKVTVKQLKEDYFKKIECFDSVEISGVEDRFNASLGTYHDLLKIIKDKDFLDNEENEDILEDIVLTLTLFEDKEMIEERLKTYAHLFDDKVMKQLKRRHYTGWGRLSRKLINGIRDKQSGKTILDFLKDGFANRNFIQLIHDDSLTFKEAIQKAQVSGQGHSLHEQIANLAGSPAIKKGILQSVKVVDELVKVMGHKPENIVIEMARENQTTQKGQKNSRERMKRIEEGIKELGSQILKEHPVENTQLQNEKLYLYYLQNGRDMYVDQELDINRLSDYDVDHIVPQSFIKDDSIDNKVLTRSDKNRGKSDDVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVSEQEIGKATAKRFFYSNIMNFFKTEITLANGEIRKRPLIETNEETGEIVWNKGRDFATVRKVLSMPQVNIVKKTEVQTGALTNESIYARGSFDKLISRKHRFESSKYGGFGSPTVTYSVLVVAKSKVQDGKVKKIKTGKELIGITLLDKLVFEKNPLKFIEDKGYGNVQIDKCIKLPKYSLFEFENGTRRMLASRGDLQKANEMFLPAKLVTLLYHAHKIESSKELEHEAYILDHYNDLYQLLSYIERFASLYVDVEKNISKVKELFSNIESYSISEICSSVINLLTLTASGAPADFKFLGTTIPRKRYGSPQSILSSTLIHQSITGLYETRIDLSQLGGD

SEQ ID NO: 104 - protein, 1356 aa, Streptococcus dysgalactiae
MDKKYSIGLDIGTNSVGWAVITDDYKVPSKKFKVLGNTDRHSIKKNLIGALLFDSGETAEATRLKRTARRRYTRRKNRIRYLQEIFSSEMSKVDDSFFHRLEESFLVEEDKKHERHPIFGNIVDEVAYHEKYPTIYHLRKKLADSTDKADLRLIYLALAHMIKFRGHFLIEGDLNPDNSDMDKLFIQLVQTYNQLFEENINASRVDAKAILSARLSKSRRLENLIAQLPGEKRNGLFGNLIALSLGLTPNFKSNFDLAEDAKLQLSKDTYDDDLDNLLAQIGDQYADLFLAAKNLSDAILLSDILRVNSEITKAPLSASMIKRYDEHHQDLTLLKALVRQQLPEKYKEIFFDQSKNGYAGYIDGGASQEEFYKFIKPILEKMDGTEELLAKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPEFLSGKQKEAIVDLLFKTNRKVTVKQLKEDYFKKIECFDSVEISGVEDRFNASLGTYHDLLKIIKDKDFLDNEENEDILEDIVLTLTLFEDKEMIEERLKKYANLFDDKVMKQLKRRHYTGWGRLSRKLINGIRDKQSGKTILDFLKDGFANRNFMQLINDDSLTFKEAIQKAQVSGQGHSLHEQIANLAGSPAIKKGILQSVKVVDELVKVMGHKPENIVIEMARENQTTQKGQKNSRERMKRIEEGIKELGSQILKEHPVENTQLQNEKLYLYYLQNGRDMYVDQELDINRLSDYDVDHIVPQSFIKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVSEQEIGKATAKRFFYSNIMNFFKTEITLANGEIRKRPLIETNEETGEIVWDKGRDFATVRKVLSMPQVNIVKKTEVQTGALTNESIYARGSFDKLISRKHRFESSKYGGFGSPTVTYSVLVVAKSKVQDGKVKKIKTGKELIGITLLDKLVFEKNPLKFIEDKGYGNVQIDKCIKLPKYSLFEFENGTRRMLASRGDLQKANEMFLPAKLVTLLYHAHKIESSKELEHEAYILDHYNDLYQLLSYIERFASLYVDVEKNISKVKELFSNIESYSISEICSSVINLLTLTASGAPADFKFLGTTIPRKRYGSPQSILSSTLIHQSITGLYETRIDLSQLGGD

SEQ ID NO: 105 - protein, 1356 aa, Streptococcus dysgalactiae
MDKKYSIGLDIGTNSVGWAVITDDYKVPSKKFKVLGNTDRHSIKKNLIGALLFDSGETAEATRLKRTARRRYTRRKNRIRYLQEIFSSEMSKVDDSFFHRLEESFLVEEDKKHERHPIFGNIVDEVAYHEKYPTIYHLRKKLADSTDKADLRLIYLALAHMIKFRGHFLIEGDLNPDNSDMDKLFIQLVQTYNQLFEENINASRVDAKAILSARLSKSRRLENLIAQLPGEKRNGLFGNLIALSLGLTPNFKSNFDLAEDAKLQLSKDTYDDDLDNLLAQIGDQYADLFLAAKNLSDAILLSDILRVNSEITKAPLSASMIKRYDEHHQDLTLLKALVRQQLPEKYKEIFFDQSKNGYAGYIDGGASQEEFYKFIKPILEKMDGTEELLAKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPEFLSGKQKEAIVDLLFKTNRKVTVKQLKEDYFKKIECFDSVEISGVEDRFNASLGTYHDLLKIIKDKDFLDNEENEDILEDIVLTLTLFEDKEMIEERLKTYAHLFDDKVMKQLKRRHYTGWGRLSRKLINGIRDKQSGKTILDFLKDGFANRNFIQLIHDDSLTFKEAIQKAQVSGQGHSLHEQIANLAGSPAIKKGILQSVKVVDELVKVMGHKPENIVIEMARENQTTQKGQKNSRERMKRIEEGIKELGSQILKEHPVENTQLQNEKLYLYYLQNGRDMYVDQELDINRLSDYDVDHIVPQSFIKDDSIDNKVLTRSDKNRGKSDDVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVSEQEIGKATAKRFFYSNIMNFFKTEITLANGEIRKRPLIETNEETGEIVWDKGRDFATVRKVLSMPQVNIVKKTEVQTGALTNESIYARGSFDKLISRKHRFESSKYGGFGSPTVTYSVLVVAKCKVQDGKVKKIKTGKELIGITLLDKLVFEKNPLKFIEDKGYGNVQIDKCIKLPKYSLFEFENGTRRMLASRGDLQKANEMFLPAKLVTLLYHAHKIESSKELEHEAYILDHYNDLYQLLSYIERFASLYVDVEKNISKVKELFSNIESYSISEICSSVINLLTLTASGAPADFKFLGTTIPRKRYGSPQSILSSTLIHQSITGLYETRIDLSQLGGD

SEQ ID NO: 106 - protein, 1356 aa, Streptococcus dysgalactiae
MDKKYSIGLDIGTNSVGWAVITDDYKVPSKKFKVLGNTDRHSIKKNLIGALLFDSGETAEATRLKRTARRRYTRRKNRIRYLQEIFSSEMSKVDDSFFHRLEESFLVEEDKKHERHPIFGNIVDEVAYHEKYPTIYHLRKKLADSTDKADLRLIYLALAHMIKFRGHFLIEGDLNPDNSDVDKLFIQLVQTYNQLFEENINASRVDAKAILSARLSKSRRLENLIAQLPGEKRNGLFGNLIALSLGLTPNFKSNFDLAEDAKLQLSKDTYDDDLDNLLAQIGDQYADLFLAAKNLSDAILLSDILRVNSEITKAPLSASMIKRYDEHHQDLTLLKALVRQQLPEKYKEIFFDQSKNGYAGYIDGGASQEEFYKFIKPILEKMDGTEELLAKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDKEMIEERLKTYAHLFDDKVMKQLKRRHYTGWGRLSRKLINGIRDKQSGKTILDFLKDGFANRNFIQLIHDDSLTFKEAIQKAQVSGQGHSLHEQIANLAGSPAIKKGILQSVKVVDELVKVMGHKPENIVIEMARENQTTQKGQKNSRERMKRIEEGIKELGSQILKEHPVENTQLQNEKLYLYYLQNGRDMYVDQELDINRLSDYDVDHIVPQSFIKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVSEQEIGKATAKRFFYSNIMNFFKTEITLANGEIRKRPLIETNEETGEIVWDKGRDFATVRKVLSMPQVNIVKKTEVQTGALTNESIYARGSFDKLISRKHRFESSKYGGFGSPTVTYSVLVVAKSKVQDGKVKKIKTGKELIGITLLDKLVFEKNPLKFIEDKGYGNVQIDKCIKLPKYSLFEFENGTRRMLASRGDLQKANEMFLPAKLVTLLYHAHKIESSKELEHEAYILDHYNDLYQLLSYIERFASLYVDVEKNISKVKELFSNIESYSISEICSSVINLLTLTASGAPADFKFLGTTIPRKRYGSPQSILSSTLIHQSITGLYETRIDLSQLGGD

SEQ ID NO: 107 - protein, 1345 aa, Streptococcus equi
MKKPYTIALDIGTNSVGWVVVTDDYRVPTKKMKVLGNTERKTIKKNLIGALLFDSGDTAEGTRLKRTARRRYTRRKNRLRYLKEIFTEEMAKVDDGFFQRLEDSFYVLEDKEGNKHPIFANLADEVAYHKKYPTIYHLRKELVDNPQKADLRLIYLAVAHIIKFRGHFLIEGTLSSKNNNLQKSFDHLVDTYNLLFEEQLLTEGINAKELLSAALSKSKRLENLISLIPGQKKTGIFGNIIALSLGLTPNFKANFGLSKDVKLQLAKDTYADDLDSLLAQIGDQYADLFLAAKNLSDAILLSDILTESDEITRAPLSASMVKRYREHHKDLVTLKTLIKDQLPEKYQEIFLDKTKNGYAGYIEGQVSQEEFYKYLKPILARLDGSEPLLLKIDREDFLRKQRTFDNGSIPHQIHLEELHAILRRQEVFYPFLKDNRKKIESLLTFRIPYYVGPLARGHSRFAWVKRKFDGAIRPWNFEEIVDEEASAQIFIEKMTKNDLYLPNEKVLPKHSLLYETFTVYNELTKVKYATEGMTRPQFLSADQKQAIVDLLFKTNRKVTVKQLKENYFKKIECWDSVEITGVEDSFNASLGTYHDLLKIIQDKDFLDNPDNQKIIEDIILTLTLFEDKKMISKRLDQYAHLFDKVVLNKLERHHYTGWGRLSGKLINGIRDKQSGKTILDFLKDGFANRNFMQLIHDSELSFIDEIAKAQVIGKTEYSKDLVGNLAGSPAIKKGISQTIKIVDELVKIMGYLPQQIVIEMARENQTTAQGIKNARQRMRKLEETAKKLGSNILKEHPVDNSQLQNDKRYLYYLQNGKDMYTGDDLDIDYLSSYDIDHIIPQSFIKNNSIDNKVLTSQGANRGKLDNVPSEAIVRKMKGYWQSLLRAGAISKQKFDNLTKAERGGLTQVDKAGFIQRQLVETRQITKHVAQILDSRFNTEFDDHNKRIRKVHIITLKSKLVSDFRKEFGLYKIRDINHYHHAHDAYLNAVVAKAILGKYPQLAPEFVYGDYPKYNSFKERQKATQKMLFYSNILKFFKDQESLHVNSDGEEIWNANKHLPIIKNVLSIPQVNIVKKTEVQTGGFYKESILSKGNSDKLIPRKNNWDTRKYGGFDSPTVAYSVLVIAKMEKGKAKVLKPVKEMVGITIMERTAFEENPVVFLEARGYREIQEHLIIKLPKYSLFELENGRRRLLASSELQKGNELFLPVDYMTFLYLAAHYHELTGSSEDVLRKKYFVDRHLHYFDDIIQMINDFAERHILASSNLEKINHTYHNNSDLPVNERAENIINVFTFVALGAPAAFKFFDATIDRKRYTSTKEVLNATLIHQSVTGLYETRIDLSQLGEN

SEQ ID NO: 108 - protein, 1345 aa, Streptococcus equi
MKKPYTIALDIGTNSVGWVVVTDDYRVPTKKMKVLGNTERKTIKKNLIGALLFDSGDTAEGTRLKRTARRRYTRRKNRLRYLKEIFTEEMAKVDDGFFQRLEDSFYVLEDKEGNKHPIFANLADEVAYHKKYPTIYHLRKELVDNPQKADLRLIYLAVAHIIKFRGHFLIEGTLSSKNNNLQKSFDHLVDTYNLLFEEQLLTEGINAKELLSAALSKSKRLENLISLIPGQKKTGIFGNIIALSLGLTPNFKANFGLSKDVKLQLAKDTYADDLDSLLAQIGDQYADLFLAAKNLSDAILLSDILTESDEITRAPLSASMVKRYREHHKDLVTLKTLIKDQLPEKYQEIFLDKTKNGYAGYIEGQVSQEEFYKYLKPILARLDGSEPLLLKIDREDFLRKQRTFDNGSIPHQIHLEELHAILRRQEVFYPFLKDNRKKIESLLTFRIPYYVGPLARGHSRFAWVKRKFDGAIRPWNFEEIVDEEASAQIFIEKMTKNDLYLPNEKVLPKHSLLYETFTVYNELTKVKYATEGMTRPQFLSADQKQAIVDLLFKTNRKVTVKQLKENYFKKIECWDSVEITGVEDSFNASLGTYHDLLKIIQDKDFLDNPDNQKIIEDIILTLTLFEDKKMISKRLDQYAHLFDKVVLNKLERHHYTGWGRLSGKLINGIRDKQSGKTILDFLKDGFANRNFMQLIHDSELSFIDEIAKAQVIGKTEYSKDLVGNLASSPAIKKGISQTIKIVDELVKIMGYLPQQIVIEMARENQTTAQGIKNARQRMRKLEETAKKLGSNILKEHPVDNSQLQNDKRYLYYLQNGKDMYTGDDLDIDYLSSYDIDHIIPQSFIKNNSIDNKVLTSQGANRGKLDNVPSEAIVRKMKGYWQSLLRAGAISKQKFDNLTKAERGGLTQVDKAGFIQRQLVETRQITKHVAQILDSRFNTEFDDHNKRIRKVHIITLKSKLVSDFRKEFGLYKIRDINHYHHAHDAYLNAVVAKAILGKYPQLAPEFVYGDYPKYNSFKERQKATQKTLFYSNILKFFKDQESLHVNSDGEEIWNANKHLPIIKNVLSIPQVNIVKKTEVQTGGFYKESILSKGNSDKLIPRKNNWDTRKYGGFDSPTVAYSVLVIAKMEKGKAKVLKPVKEMVGITIMERIAFEENPVVFLEAKGYREIQEHLIIKLPKYSLFELENGRRRLLASSELQKGNELFLPVDYMTFLYLAAHYHELTGSSEDVLRKKYFVERHLHYFDDIIQMINDFAERHILASSNLEKINHTYHNNSDLPINERAENIINVFTFVALGAPAAFKFFDATIDRKRYTSTKEVLNATLIHQSVTGLYETRIDLSQLGEN

SEQ ID NO: 109 - protein, 1345 aa, Streptococcus equi
MKKPYTIALDIGTNSVGWVVVTDDYRVPTKKMKVLGNTERKTIKKNLIGALLFDSGDTAEGTRLKRTARPRYTRRKNRLRFLKEIFTEEMAKVDDGFFQRLEDSFYVLEDKEGNKHPIFANLADEVAYHKKYPTIYHLRKELVDNPQKADLRLIYLAVAHIIKFRGHFLIEGTLSSKNNNLQKSFDHLVDTYNLLFEEQLLTEGINAKELLSAALSKSKRLENLISLIPGQKKTGIFGNIIALSLGLTPNFKANFGLSKDVKLQLAKDTYADDLDSLLAQIGDQYADLFLAAKNLSDAILLSDILTESDEITRAPLSASMVKRYREHHKDLVTLKTLIKDQLPEKYQEIFLDKTKNGYAGYIEGQVSQEEFYKYLKPILARLDGSEPLLLKIDREDFLRKQRTFDNGSIPHQIHLEELHAILRRQEVFYPFLKDNRKKIESLLTFRIPYYVGPLARGHSRFAWVKRKFDGAIRPWNFEEIVDEEASAQIFIEKMTKNDLYLPNEKVLPKHSLLYETFTVYNELTKVKYATEGMTRPQFLSADQKQAIVDLLFKTNRKVTVKQLKENYFKKIECWDSVEITGVEDSFNASLGTYHDLLKIIQDKDFLDNPDNQKIIEDIILTLTLFEDKKMISKRLDQYAHLFDKVVLNKLERHHYTGWGRLSGKLINGIRDKQSGKTILDFLKDGFANRNFMQLIHDSELSFIDEIAKAQVIGKTEYSKDLVGNLAGSPAIKKGISQTIKIVDELVKIMGYLPQQIVIEMARENQTTAQGIKNARQRMRKLEETAKKLGSNILKEHPVDNSQLQNDKRYLYYLQNGKDMYTGDDLDIDYLSSYDIDHIIPQSFIKNNSIDNKVLTSQGANRGKLDNVPSEAIVRKMKGYWQSLLRAGAISKQKFDNLTKAERGGLTQVDKAGFIQLQLVETRQITKHVAQILDSRFNTEFDDHNKRIRKVHIITLKSKLVSDFRKEFGLYKIRDINHYHHAHDAYLNAVVAKAILGKYPQLAPEFVYGDYPKYNSFKERQKATQKTLFYSNILKFFKDQESLHVNSDGEEIWNANKHLPIIKNVLSIPQVNIVKKTEVQTGGFYKESILSKGNSDKLIPRKNNWDTRKYGGFDSPTVAYSVLVIAKMEKGKAKVLKPVKEMVGITIMERIAFEENPVVFLEAKGYREIQEHLIIKLPKYSLFELENGRRRLLASSELQKGNELFLPVDYMTFLYLAAHYHELTGSSEDVLRKKYFVERHLHYFDDIIQMINDFAERHILASSNLEKINHTYHNNSDLPVNERAENIINVFTFVALGAPAAFKFFDATIDRKRYTSTKEVLNATLIHQSVTGLYETRIDLSQLGEN

SEQ ID NO: 110 - protein, 1360 aa, Streptococcus equinus
MEKTYSIGLDIGTNSVGWAVITDDYKVPAKKMKVLGNTDKKYIKKNLLGALLFDSGETAEATRLKRAARRRYTRRKNRLRYLQEIFAKEMAKVDESFFQRLEESFLTDDDKTFDSHPIFGNKAEEDTYHQEFPTIYHLRKHLADSPEKVDLRLVYLALAHMIKFRGHFLIEGQLNAENTDVQKIFADFVGVYDRTFDDSHLSEITVDAASILTEKISKSRRLENLIKQYPTEKKNTLFGNLVALALGLQPNFKTNFKLSEDAKLQFSKDTYDEDLEELLGKIGDDYADLFTAAKNLYDAILLSGILTVDDNSTKAPLSASMIKRYEEHHEDLEKLKTFIKVNNFDKYHEIFKDKSKNGYAGYIENGVKQDIFYKHLKSIISEKNGGQYFLDKIEREDFLRKQRTFDNGSIPYQIHLQEMRTILRRQGEYYPFLKENQAKIEKILTFRIPYYVGPLARKNSRFAWAKYHSDEPITPWNFDEVVDKEKSAEKFITRMTLNDLYLPEEKVLPKHSYVYETFAVYNELTKIKYVNEQGKSFFFDANMKQEIFDHVFKENRKVTKAKLLSYLNNEFEEFRINDLIGLDKDSKSFNASLGTYHDLKKILDKSFLDDKTNEQIIEDIVLTLTLFEDRDMIHERLQKYSDIFTSQQLKKLERRHYTGWGRLSYKLINGIRNKENNKTILDFLIDDGDANRNFMQLINDDSLSFKTTIQEAQVVGDVDDIEAVVHDLPGSPAIKKGILQSVKIVDELVKVMGHNPQNIVIEMARENQITGYGRNRSNQRLKRLQDSLKPSYVDSKVENSHLQNDRLFLYYIQNGKDMYTGEELDIDHLSDYDIDHIIPQAFIKDNSIDNRVLTSSAKNRGKSDDVPSIEIVRNRKSYWYKLYKSGLISKRKFDNLTKAERGGLTETDKAGFIKRQLVETRQITKHVAQILDARFNTKCDENDKVIRDVKVITLKSSLVSQFRKEFKFYKVREINDYHHAHDAYLNAVVGTALLKKYPKLAPEFVYGEYKKYDVSSDNHSELGKATAKYFFYSNLMNFFKTEVKYADGRVFERPDIETNADGEVVWNKQRDFNIVRKVLSYPQVNIVKKVEVQTGGFSKESILPKGDSDKLIPRKTKKLQWETQKYGGFDSPTVAYSVLVVADVEKGKTRKLKTVKELVGISIMERSSFEENPVSFLEKKGYHNVQEDKLIKLPKYSLFEFEGGRRRLLASATELQKGNEVVLPQYMVNLLYHSQHVNNSHKPEHLNYVKQHKDEFKDIFNLIISIARINILKPKVVDNLINEFTEYGQEDISSLSESFINLLKFISFGAPGAFKFLKLDVKQSNLRYKSTTEALSATLIHQSVTGLYETRIDLSKLGEE

SEQ ID NO: 111 - protein, 1353 aa, Streptococcus gallolyticus
MTKKNYSIGLDIGTNSVGWAVITDDYKVPAKKMKVLGNTDKKYIKKNLLGALLFDSGETAEATRLKRTARRRYTRRKNRLRYLQEIFAEEMTKVDESFFYRLDESFLTTDEKDFERHPIFGNKAEEDAYHQKFPTIYHLRNYLADSSEKADLRLVYLALAHMIKYRGHFLIEGKLNAENTDVQKLFTDFVGVYDRTFDDSHLSEITVDVASTLTEKISKSRRLENLIKYYPTEKKNTLFGNLIALALGLQPNFKMNFKLSEDAKLQFSKDTYEEDLEELLGKIGDDYADLFTSAKNLYDAILLSGILTVDDNSTKAPLSASMIKRYVEHHEDLEKLKEFIKANKSELYHDIFKDKNKNGYAGYIENGVKQDEFYKYLKNTLSKIDGSDYFLDKIEREDFLRKQRTFDNGSIPHQIHLQEMHAILRRQGDYYPFLKEKQDRIEKILTFRIPYYVGPLVRKDSRFAWAEYRSDEKITPWNFDKVIDKEKSAEKFITRMTLNDLYLPEEKVLPKHSHVYETYAVYNELTKIKYVNEQGKESFFDSNMKQEIFDHVFKENRKVTKEKLLNYLNKEFPEYRIKDLIGLDKENKSFNASLGTYHDLKKILDKAFLDDKVNEEVIEDIIKTLTLFEDKDMIHERLQKYSDIFTANQLKKLERRHYTGWGRLSYKLINGIRNKENNKTILDYLIDDGSANRNFMQLINDDTLPFKQIIQKSQVVGDVDDIEAVVHDLPGSPAIKKGILQSVKIVDELVKVMGDNPDNIVIEMARENQTTNRGRSQSQQRLKKLQSSLKPSYIEDKVENSHLQNDQLFLYYIQNGKDMYTGDELDIDHLSDYDIDHIIPQAFIKDDSIDNRVLTSSAKNRGKSDDVPSLDIVRARKAEWVRLYKSGLISKRKFDNLTKAERGGLTEADKAGFIKRQLVETRQITKHVAQILDARFNTEHDENDKVIRDVKVITLKSNLVSQFRKDFEFYKVREINDYHHAHDAYLNAVVGTALLKKYPKLASEFVYGEYKKYDISSDKATAKYFFYSNLMNFFKTKVKYADGTVFERPIIETNADGEIAWNKQIDFEKVRKVLSYPQVNIVKKVETQTGGFSKESILPKGDSDKLIPRKTKKVYWDTKKYGGFDSPTVAYSVFVVADVEKGKAKKLKTVKELVGISIMERSFFEENPVEFLENKGYHNIREDKLIKLPKYSLFEFEGGRRRLLASASELQKGNEMVLPGYLVELLYHAHRADNFNSTEYLNYVSEHKKEFEKVLSCVEDFANLYVDVEKNLSKIRAVADSMDNFSIEEISNSFINLLTLTALGAPADFNFLGEKIPRKRYTSTKECLTATLIHQSITGLYETRIDLSKLGEE

SEQ ID NO: 112 - protein, 1354 aa, Streptococcus gallolyticus
MTEKNYSIGLDIGTNSVGWAVITDDYKVPAKKMKVLGNTDKKYIKKNLLGALLFDNGETAEATRLKRTARRRYTRRKNRLRYLQEIFAEEMAKVDESFFYRLDESFLTTDDKDFERHPIFGNKADEIKYHQEFPTIYHLRKHLADSHEKADLRLIYLALAHMIKFRGHFLIEGELNAENTDVQKLFEAFVEVYDRTFDDSNLSEITVDASSILTEKFSKSRRLENLIKHYPTEKKNTLFGNLVALALGLQPNFKTSFKLSEDAKLQFSKDTYEEDLEELIGKIGDEYADLFTSAKNLYDAILLSGILTVADNTTKAPLSASMIKRYNEHQVDLKKLKEFIKNNASDKYDEIFNDKDKNGYAGYIENGVKQDEFYKYLKTTLSKIDGSDYFLDKIEREDFLRKQRTFDNGSIPHQIHLQEMHAILRRQGEHYAFLKENQAKIEKILTFRIPYYVGPLARKNSRFAWAEYHSDEKITPWNFDEIIDKEKSAEKFITRMTLNDLYLPEEKVLPKHSLVYETYTVYNELTKVKYVNEQGKSNFFDANMKQEIFEHVFKENRKVTKDKFLNYLNKEFPEYRIQDLIGLDKENKSFNASLGTYHDLKKILDKSFLDDKTNETIIEDIIQTLTLFEDRDMIRQRLQKYSDIFTPQQLKKLERRHYTGWGRLSYKLINGIRNKENGKSILDYLIDDGYANRNFMQLISDDTLPFKQIIKDAQIIGDIDDVTSVVRELPGSPAIKKGILQSVKIVDELVKVMGHNPDNIVIEMARENQTTNRGRNQSQQRLKKLQDSLKPSYIEGKVENNHLQDDRLFLYYIQNGKDMYTGDELDIDHLSDYDIDHIIPQAFIKDDSIDNRVLTSSAKNRGKSDDVPSLDIVHDRKADWIRLYKSGLISKRKFDNLTKAERGGLTENDKAGFIKRQLVETRQITKHVAQILDSRFNTERDENDKVIRNVKVITLKSNLVSQFRKDFKFYKVREINDYHHAHDAYLNAVVGTALLKKYPKLAPEFVYGEYKKYDISGDKATAKYFFYSNLMNFFKRVIRYSNGKVVVRPVIECSKDTGEIAWNKQTDFEKVRRVLSYPQVNIVKKVETQTGGFSKESILPKGNSDKLIPRKTKKFRWDTPKYGGFDSPNIAYSVFVIADVEKGKAKKLKTVKELVGISIMERSSFEENPVVFLEKKGYQNVQEDNLIKLPKYSLFEFEGGRRRLLASASELQKGNEVVLSRHLVELLYHAHRVNSFNNSEHLKYVSEHKKEFGEVLSCVENFAKSYVDVEKNLGKIRAVADKIDTFSIEDISISFVNLLTLTALGAPADFNFLGEKIPRKRYTSTKECLNATLIHQSITGLYETRIDLSKLGEE

SEQ ID NO: 113 - protein, 1355 aa, Streptococcus gallolyticus; identical to SEQ ID NO: 12

SEQ ID NO: 114 - protein, 1358 aa, Streptococcus infantarius
MEKSYSIGLDIGTNSVGWAVITDDYKVPAKKMKVLGNTDKKYIKKNLLGALLFDSGETAEVTRLKRTARRRYTRRKNRLRYLQEIFAKEMTKVDESFFQRLEESFLTDDDKTFDSHPIFGNKAEEDAYHQKFPTIYHLRKYLADSQEKADLRLVYLALAHMIKYRGHFLIEGELNAENTDVQKLFNVFVETYDKIVDESHLSEIEVDASSILTEKVSKSRRLENLIKQYPTEKKNTLFGNLIALALGLQPNFKTNFKLSEDAKLQFSKDTYEEDLEELLGKVGDDYADLFISAKNLYDAILLSGILTVDDNSTKAPLSASMIKRYVEHHEDLEKLKEFIKINKLKLYHDIFKDKTKNGYAGYIDNGVKQDEFYKYLKTILTKIDDSDYFLDKIERDDFLRKQRTFDNGSIPHQIHLQEMHSILRRQGDYYPFLKENQAKIEKILTFRIPYYVGPLARKDSRFAWANYHSDEPITPWNFDEVVDKEKSAEKFITRMTLNDLYLPEEKVLPKHSHVYETFTVYNELTKIKYVNEQGESFFFDANMKQEIFDHVFKENRKVTKAKLLSYLNNEFEEFRINDLIGLDKDSKSFNASLGTYHDLKKILDKSFLDDKTNGQIIEDIVLTLTLFEDRDMIHERLQKYSDFFTSQQLKKLERRHYTGWGRLSYKLINGIRNKENNKTILDFLIDDGHANRNFMQLINDESLSFKTIIQEAQVVGDVDDIEAVVHDLPGSPAIKKGILQSVKIVDELVKVMGDNPDNIVIEMARENQTTGYGRNKSNQRLKRLQDSLKPSYVDSKVENSHLQNDRLFLYYIQNGKDMYTGEELDIDRLSDYDIDHIIPQAFIKDNSIDNKVLTSSAKNRGKSDDVPSIEIVRNRRSYWYKLYKSGLISKRKFDNLTKAERGGLTEADKAGFIKRQLVETRQITKHVAQILDARFNTKRDENDKVIRDVKVITLKSNLVSQFRKEFKFYKVREINDYHHAHDAYLNAVVGTALLKKYPKLTPEFVYGEYKKYDVSSDDYSEMGKATAKYFFYSNLMNFFKTEVKYADGRVFERPDIETNADGEVVWNKQKDFDIVRKVLSYPQVNIVKKVEAQTGGFSKESILSKGDSDKLIPRKTKKVYWNTKKYGGFDSPTVAYSVLVVADIEKGKAKKLKTVKELVGISIMERSFFEENPVSFLEKKGYHNVQEDKLIKLPKYSLFEFEGGRRRLLASATELQKGNEVMLPAHLVELLYHAHRIDSFNSTEHLKYVSEHKKEFEKVLSCVENFSNLYVDVEKNLSKVRAAAESMTNFSLEEISASFINLLTLTALGAPADFNFLGEKIPRKRYTSTKECLSATLIHQSVTGLYETRIDLSKLGEE

SEQ ID NO: 115 - protein, 1358 aa, Streptococcus iniae
MRKPYSIGLDIGTNSVGWAVITDDYKVPSKKMRIQGTTDRTSIKKNLIGALLFDNGETAEATRLKRTTRRRYTRRKYRIKELQKIFSSEMNELDIAFFPRLSESFLVSDDKEFENHPIFGNLKDEITYHNDYPTIYHLRQTLADSDQKADLRLIYLALAHIIKFRGHFLIEGNLDSENTDVHVLFLNLVNIYNNLFEEDVETASIDAEKILTSKTSKSRRLENLIAEIPNQKRNMLFGNLVSLALGLTPNFKTNFELLEDAKLQISKDSYEEDLDNLLAQIGDQYADLFIAAKKLSDAILLSDIITVKGASTKAPLSASMVQRYEEHQQDLALLKNLVKKQIPEKYKEIFDNKEKNGYAGYIDGKTSQEEFYKYIKPILLKLDGTEKLISKLEREDFLRKQRTFDNGSIPHQIHLNELKAIIRRQEKFYPFLKENQKKIEKLFTFKIPYYVGPLANGQSSFAWLKRQSNESITPWNFEEVVDQEASARAFIERMTNFDTYLPEEKVLPKHSPLYEMFMVYNELTKVKYQTEGMKRPVFLSSEDKEEIVNLLFKKERKVTVKQLKEEYFSKMKCFHTVTILGVEDRFNASLGTYHDLLKIFKDKAFLDDEANQDILEEIVWTLTLFEDQAMIERRLVKYADVFEKSVLKKLKKRHYTGWGRLSQKLINGIKDKQTGKTILGFLKDGVANRNFMQLINDSSLDFAKIIKNEQEKTIKNESLEETIANLAGSPAIKKGILQSIKIVDEIVKIMGQNPDNIVIEMARENQSTMQGIKNSRQRLRKLEEVHKNTGSKILKEYNVSNTQLQSDRLYLYLLQDGKDMYTGKELDYDNLSQYDIDHIIPQSFIKDNSIDNTVLTTQASNRGKSDNVPNIETVNKMKSFWYKQLKSGAISQRKFDHLTKAERGALSDFDKAGFIKRQLVETRQITKHVAQILDSRFNSNLTEDSKSNRNVKIITLKSKMVSDFRKDFGFYKLREVNDYHHAQDAYLNAVVGTALLKKYPKLEAEFVYGDYKHYDLPDSSLGKATTRMFFYSNLMNFFKKEIKLADDTIFTRPQIEVNTETGEIVWDKVKDMQTIRKVMSYPQVNIVMKTEVQTGGFSKESIWPKGDSDKLIARKKSWDPKKYGGFDSPIIAYSVLVVAKIAKGKTQKLKTIKELVGIKIMEQDEFEKDPIAFLEKKGYQDIQTSSIIKLPKYSLFELENGRKRLLASELQKGNELALPNKYVKFLYLASHYTKFTGKEEDREKKRSYVESHLYYFDEIMQIIVEYSNRYILADSNLIKIQNLYKEKDNFSIEEQAINMLNLFTFTDLGAPSAFKFFNGDIDRKRYSSTNEIINSTLIYQSPTGLYETRIDLSKLGGK

SEQ ID NO: 116 - protein, 1263 aa, Streptococcus iniae
  misc_feature (1257)..(1257): Xaa can be any naturally occurring amino acid
MRKPYSIGLDIGTNSVGWAVITDDYKVPSKKMRIQGTTDRTSIKKNLIGALLFDNGETAEATRLKRTTRRRYTRRKYRIKELQKIFSSEMNELDIAFFPRLSESFLVSDDKEFENHPIFGNLKDEITYHNDYPTIYHLRQTLADSDQKADLRLIYLALAHIIKFRGHFLIEGNLDSENTDVHVLFLNLVNIYNNLFEEDVETASIDAEKILTSKTSKSRRLENLIAEIPNQKRNMLFGNLVSLALGLTPNFKTNFELLEDAKLQISKDSYEEDLDNLLAQIGDQYADLFIAAKKLSDAILLSDIITVKGASTKAPLSASMVQRYEEHQQDLALLKNLVKKQIPEKYKEIFDNKEKNGYAGYIDGKTSQEEFYKYIKPILLKLDGTEKLISKLEREDFLRKQRTFDNGSIPHQIHLNELKAIIRRQEKFYPFLKENQKKIEKLFTFKIPYYVGPLANGQSSFAWLKRQSNESITPWNFEEVVDQEASARAFIERMTNFDTYLPEEKVLPKHSPLYEMFMVYNELTKVKYQTEGMKRPVFLSSEDKEEIVNLLFKKERKVTVKQLKEEYFSKMKCFHTVTILGVEDRFNASLGTYHDLLKIFKDKAFLDDEANQDILEEIVWTLTLFEDQAMIERRLVKYADVFEKSVLKKLKKRHYTGWGRLSQKLINGIKDKQTGKTILGFLKDGVANRNFMQLINDSSLDFAKIIKNEQEKTIKNESLEETIANLAGSPAIKKGILQSIKIVDEIVKIMGQNPDNIVIEMARENQSTMQGIKNSRQRLRKLEEVHKNTGSKILKEYNVSNTQLQSDRLYLYLLQDGKDMYTGKELDYDNLSQYDIDHIIPQSFIKDNSIDNTVLTTQASNRGKSDNVPNIETVNKMKSFWYKQLKSGAISQRKFDHLTKAERGALSDFDKAGFIKRQLVETRQITKHVAQILDSRFNSNLTEDSKSNRNVKIITLKSKMVSDFRKDFGFYKLREVNDYHHAQDAYLNAVVGTALLKKYPKLEAEFVYGDYKHYDLPDSSLGKATTRMFFYSNLMNFFKKEIKLADDTIFTRPQIEVNTETGEIVWDKVKDMQTIRKVMSYPQVNIVMKTEVQTGGFSKESIWPKGDSDKLIARKKSWDPKKYGGFDSPIIAYSVLVVAKIAKGKTQKLKTIKELVGIKIMEQDEFEKDPIAFLEKKGYQDIQTSSIIKLPKYSLFELENGRKRLLASELQKGNELALPNKYVKFLYLASHYTKFTGKEEDREKKRSYVESHLYYFXEVKSSF

SEQ ID NO: 117 - protein, 1257 aa, Streptococcus iniae
  misc_feature (1255)..(1255): Xaa can be any naturally occurring amino acid
  misc_feature (1257)..(1257): Xaa can be any naturally occurring amino acid
MRKPYSIGLDIGTNSVGWAVITDDYKVPSKKMRIQGTTDRTSIKKNLIGALLFDNGETAEATRLKRTTRRRYTRRKYRIKELQKIFSSEMNELDIAFFPRLSESFLVSDDKEFENHPIFGNLKDEITYHNDYPTIYHLRQTLADSDQKADLRLIYLALAHIIKFRGHFLIEGNLDSENTDVHVLFLNLVNIYNNLFEEDVETASIDAEKILTSKTSKSRRLENLIAEIPNQKRNMLFGNLVSLALGLTPNFKTNFELLEDAKLQISKDSYEEDLDNLLAQIGDQYADLFIAAKKLSDAILLSDIITVKGASTKAPLSASMVQRYEEHQQDLALLKNLVKKQIPEKYKEIFDNKEKNGYAGYIDGKTSQEEFYKYIKPILLKLDGTEKLISKLEREDFLRKQRTFDNGSIPHQIHLNELKAIIRRQEKFYPFLKENQKKIEKLFTFKIPYYVGPLANGQSSFAWLKRQSNESITPWNFEEVVDQEASARAFIERMTNFDTYLPEEKVLPKHSPLYEMFMVYNELTKVKYQTEGMKRPVFLSSEDKEEIVNLLFKKERKVTVKQLKEEYFSKMKCFHTVTILGVEDRFNASLGTYHDLLKIFKDKAFLDDEANQDILEEIVWTLTLFEDQAMIERRLVKYADVFEKSVLKKLKKRHYTGWGRLSQKLINGIKDKQTGKTILGFLKDGVANRNFMQLINDSSLDFAKIIKNEQEKTIKNESLEETIANLAGSPAIKKGILQSIKIVDEIVKIMGQNPDNIVIEMARENQSTMQGIKNSRQRLRKLEEVHKNTGSKILKEYNVSNTQLQSDRLYLYLLQDGKDMYTGKELDYDNLSQYDIDHIIPQSFIKDNSIDNTVLTTQASNRGKSDNVPNIETVNKMKSFWYKQLKSGAISQRKFDHLTKAERGALSDFDKAGFIKRQLVETRQITKHVAQILDSRFNSNLTEDSKSNRNVKIITLKSKMVSDFRKDFGFYKLREVNDYHHAQDAYLNAVVGTALLKKYPKLEAEFVYGDYKHYDLPDSSLGKATTRMFFYSNLMNFFKKEIKLADDTIFTRPQIEVNTETGEIVWDKVKDMQTIRKVMSYPQVNIVMKTEVQTGGFSKESIWPKGDSDKLIARKKSWDPKKYGGFDSPIIAYSVLVVAKIAKGKTQKLKTIKELVGIKIMEQDEFEKDPIAFLEKKGYQDIQTSSIIKLPKYSLFELENGRKRLLASELQKGNELALPNKYVKFLYLASHYTKFTGKEEDREKKRSYVESHLYXFX

SEQ ID NO: 118 - protein, 199 aa, Streptococcus iniae
MEQDEFEKDPIAFLEKKGYQDIQTSSIIKLPKYSLFELENGRKRLLASKELQKGNELALPNKYVKFLYLASHYTKFTGKEEDREKKRSYVESHLYYFDEIMQIIVEYSNRYILADSNLIKIQNLYKEKDNFSIEEQAINMLNLFTFTDLGAPSAFKFFNGDIDRKRYSSTNEIINSTLIYQSPTGLYETRIDLSKLGGK

SEQ ID NO: 119 - protein, 1271 aa, Streptococcus iniae
MRKPYSIGLDIGTNSVGWAVITDDYKVPSKKMRIQGTTDRTSIKKNLIGALLFDNGETAEATRLKRTTRRRYTRRKYRIKELQKIFSSEMNELDIAFFPRLSESFLVSDDKEFENHPIFGNLKDEITYHNDYPTIYHLRQTLADSDQKADLRLIYLALAHIIKFRGHFLIEGNLDSENTDVHVLFLNLVNIYNNLFEEDVETASIDAEKILTSKTSKSRRLENLIAEIPNQKRNMLFGNLVSLALGLTPNFKTNFELLEDAKLQISKDSYEEDLDNLLAQIGDQYADLFIAAKKLSDAILLSDIITVKGASTKAPLSASMVQRYEEHQQDLALLKNLVKKQIPEKYKEIFDNKEKNGYAGYIDGKTSQEEFYKYIKPILLKLDGTEKLISKLEREDFLRKQRTFDNGSIPHQIHLNELKAIIRRQEKFYPFLKENQKKIEKLFTFKIPYYVGPLANGQSSFAWLKRQSNESITPWNFEEVVDQEASARAFIERMTNFDTYLPEEKVLPKHSPLYEMFMVYNELTKVKYQTEGMKRPVFLSSEDKEEIVNLLFKKERKVTVKQLKEEYFSKMKCFHTVTILGVEDRFNASLGTYHDLLKIFKDKAFLDDEANQDILEEIVWTLTLFEDQAMIERRLVKYADVFEKSVLKKLKKRHYTGWGRLSQKLINGIKDKQTGKTILGFLKDGVANRNFMQLINDSSLDFAKIIKNEQEKTIKNESLEETIANLAGSPAIKKGILQSIKIVDEIVKIMGQNPDNIVIEMARENQSTMQGIKNSRQRLRKLEEVHKNTGSKILKEYNVSNTQLQSDRLYLYLLQDGKDMYTGKELDYDNLSQYDIDHIIPQSFIKDNSIDNTVLTTQASNRGKSDNVPNIETVNKMKSFWYKQLKSGAISQRKFDHLTKAERGALSDFDKAGFIKRQLVETRQITKHVAQILDSRFNSNLTEDSKSNRNVKIITLKSKMVSDFRKDFGFYKLREVNDYHHAQDAYLNAVVGTALLKKYPKLEAEFVYGDYKHYDLPDSSLGKATTRMFFYSNLMNFFKKEIKLADDTIFTRPQIEVNTETGEIVWDKVKDMQTIRKVMSYPQVNIVMKTEVQTGGFSKESIWPKGDSDKLIARKKSWDPKKYGGFDSPIIAYSVLVVAKIAKGKTQKLKTIKELVGIKIMEQDEFEKDPIAFLEKKGYQDIQTSSIIKLPKYSLFELENGRKRLLASELQKGNELALPNKYVKFLYLASHYTKFTGKEEDREKKRSYVESHLYYFDVRLSQVFRVTNVEF

SEQ ID NO: 120 - protein, 1345 aa, Streptococcus intermedius
MKKPYSIGLDIGTNSVGWAVVTDDYKVPAKKMKVLGNTDKSHIKKNLLGALLFDSGNTAEDRRLKRTARRRYTRRRNRILYLQEIFSEEMGKVDDSFFHRLEDSFLVTEDKRGERHPIFGNLEEEVKYHENFPTIYHLRQYLADNPEKTDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDTYEEELEVLLAQIEDNYAELFLSAKKLYDSILLSGILTVTDVSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYIGPLARGKSDFSWLSRKSADKITPWNFDEIVDKESSAEAFINRMTNYDLYLPNQKVLPRHSLLYEKFTVYNELTKVKYKTEQGKTAFFDANMKQEIFDGVFKVYRKVTKDKLMDFLEKEFDEFRIVDLTGLDKENKAFNASYGTYHDLRKILDKDFLDNSKNEKILEDIVLTLTLFEDREMIRKRLENYSDLLTKEQVKNLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKSYWSKLLSAKLITQRKFDNLTKAERGGLTDDDKAGFIKRQLVETRQITKHVARILDERFNTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIANIEKGKSKKLKLVKDLVGITIMERTIFEKNPVAFLERKGYRNVQEENIVKLPKYSLFELENGRRRLLASARELQKGNEIVLPNHLGTMLYHAKNIHKVDEPKHLDYVKKHKDEFKELLDVVSNFSKKNILAESNLEKIEELYAQNNNKDITELASSFINLLTFTAIGAPAAFKFFDNNIDRKRYTSTTEILNATLIHQSITGLYETRIDLSRLGGD

SEQ ID NO: 121 - protein, 1333 aa, Streptococcus massiliensis
MKKPYSIGLDIGTNSVGWAVVMEDYKVPSKKMKVLGNTDKQSIKKNLIGALLFDSGETAVERRLNRTTSRRYDRRRNRIRYLQHIFAEEMNRADENFFHRLKESFFVEEDKTYSKYPIFGTLEEEKNYHKNYPTIYHLRKTLADTPDKMDIRLIYLALAHIIKYRGHFLIEGDLDIENIGIQDSFKSFIEEYNTQFGTKLDSTTKVEAIFTENSSKAKRVETILGLFPDETAAGNLDKFLKLMLGNQADFKKVFDLEEKITLQFSKDSYEEDLELLLSKIDEEYAALFDLAKKVYDAVLLSNILTVKEKNTKAPLSASMIKRYEEHKDDLKAFKRFFRERLPEKYETMFKDLTKPSYAAYVSGAVTEDDFYKFSKGLLIDVEGAEYFLEKIEREDFLRKQRTFDNGAIPNQVHVKELQAIILNQSKYYPFLAENKEKIEKILTFRIPYYVGPLARGNSSFAWLQRKSDEAIRPWNFEQVVDMETSASRFIERMTLHDLYLPDEKVLPRHSLIYEKYTVFNELTKVRFTPEGGKEVYFSKTDKENIFDSLFKRYRKVTKRKLKDFIEKELGYGYIDIDNIKGVEEQFNASYTTYQDLLKIIGDKEFLDNEENKDLLEEIIYILTVFEDRKMIEKRLSELNIPFENKIIKKLARKKYTGWGNLSRKLIDGIRNRETNRTILGHLIDDGFSNRNLMQLINDDGLDFKEIIRKAQTIENIDTNQALVSSLPGSPAIKKGILQSLNIVDEIIAIMGYAPTNIVIEMARENQTTQKGRDNSAQRLKKIEDGIKLGSDLLKQNPIQDNKDLQKEKLFLYYMQNGIDLYTGQPLNCDPDSLAFYDVDHIVPRSYIKNDSFDNKVLTTSKGNRKKLDDVPAKEVVEKMENTWRRLHAAGLISDIKLSYLMKGELTEEDKAGFIRRQLVETRQITKHVARLLDEKLNRKKNENGEKLRTTKIITLKSVFASRFRANFDLYKLRELNHYHHAHDAYLNAVVAQALLKVYPKFERELVYGSYVKESIFSRKATERMRMYNNILKFISKDKKDQETGEIVWDKKEIENIVKKVIYSSPVNIVKKREEQSGALFKQSNMAVGYNNKLIPRKKDWSVDKYGGFIEPAESYSLAIFYTDINGKKPKKKSTIIAISRMEKKDYEKEPERFLAQKGFERVEKTIKLPKYSLFEMEKGRRRLLASSGELQKGNQVLLPEHLIRLLSYAKKVDVLVKSKDDDYDLEEHRAEFAELLDCIKKFNDMYILASSNMSKIEEIYQKNIDAPIEEVARSFVLLNFTMMGAATDFKFFGQIIPRKRYPSTTECLKSTLIHQSVTGLYETRIDLSKLGEN

SEQ ID NO: 122 - protein, 1361 aa, Streptococcus mitis
NNKPYSIGLDIGTNSVGWAVITDDYKVPSKKMKVLGNTDKHFIKKNLLGALLFDEGTTAEDRRLKRTARRRYTRRKNRLRYLQEIFTEEMSKVDISFFHRLDDSFLVPEDKRGSKYPIFATLEEEKEYHKNFPTIYHLRKHLADSKEKADFRLIYLALAHIIKYRGHFLYEESFDIKNNDIQKIFNEFISIYDNTFEGSSLNGQNAQVEAIFTDKISKSAKRERVLKLFPDEKSTGLFSEFLKLIVGNQADFKKHFDLEEKAPLQFSKDTYDEDLENLLVQIGDDFADLFLVAKKLYDAILLSGILTVTDPSTKAPLSASMIDRYENHQKDLAALKQFIKTNLPEKYDEVFSDQSKDGYAGYIDGKTTQEAFYKYIKNLLSKLEGADYFLDKIEREDFLRKQRTFDNGSIPHQIHLQEMNAIIRRQGEHYPFLQENKEKIEKILTFRIPYYVGPLARGNRDFAWLTRNSDQAIRPWNFEEIVDKARSAEDFINKMTNYDLYLPEEKVLPKHSLLYETFAVYNELTKVKFIAEGLRDYQFLDSGQKQQIVTQLFKEKRKVTEKDIIQYLHNVDSYDGIELKGIEKQFNASLSTYHDLLKIIKDKEFMDDSKNEAILENIVHTLTIFEDREMIKQRLAHYASIFDEKVIKALTRRHYTGWGKLSAKLINGIYDKQSKKTILDYLIDDGEINRNFMQLINDDGLSFKEIIQKAQVVGKTNDVKQVVQELPGSPAIKKGILQSIKLVDELVKVMGHAPESIVIEMARENQTTARGKKNSQQRYKRIEDALKNLAHNILKEHPTDNIQLQNDRLFLYYLQNGKDMYTGKSLDINQLSSCDIDHIIPQAFIKDDSLDNRVLTSSKDNRGKSDNVPSLEIVQKRKAFWQQLLDSKLISERKFNNLTKAERGGLDERDKVGFIKRQLVETRQITKHVAQILDARFNTEVTEKDKKDRSVKIITLKSNLVSNFRKEFRLYKVREINDYHHAHDPYLNAVVAKAILKKYPKLEPEFVYGDYQKYDLTKDPKEVEKATEKYFFYSNLLNFFKEEVHYADGTIVKRENIEYSKDTGEIAWNKEKDFATIKKVLSLPQVNIVKKTEEQTGGLFDNNIVSKKKVVDASKLTPIKSGLSPEKYGGYARPTIAYSVLVIADIEKGKAKKLKRIKEMVGITVQDKKKFEANPIAYLEECGYKNINPNLIIKLPKYSLFEFNNGQRRLLASSIELQKGNELIVPYHFTALLYHAQRINKISEPIHKQYVETHQSEFKELLTAIISLSKKYIQKPNVESLLQQAFDQSDKDIYQLSESFISLLKLISFGAPGTFKFLGVEISQSNVRYQSVSSCFNATLIHQSITGLYETRIDLSKLGED

SEQ ID NO: 123 - protein, 1359 aa, Streptococcus mitis; identical to SEQ ID NO: 13

SEQ ID NO: 124 - protein, 1345 aa, Streptococcus mutans
MKKPYSIGLDIGTNSVGWAVVTDDYKVPAKKMKVLGNTDKSHIEKNLLGALLFDSGNTAEDRRLKRTARRRYTRRRNRILYLQEIFSEEMGKVDDSFFHRLEDSFLVTEDKRGERHPIFGNLEEEVKYHENFPTIYHLRQYLADNPEKVDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDTYEEELEVLLAQIGDNYAELFLSAKKLYDSILLSGILTVTDVGTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKLLTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKVFNASYGTYHDLCKILDKDFLDNSKNEKILEDIVLTLTLFEDREMIRKRLENYSDLLTKEQVKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKSYWSKLLSAKLITQRKFDNLTKAERGGLTDDDKAGFIKRQLVETRQITKHVARILDERFNTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLNKLGGD

SEQ ID NO: 125 - protein, 1345 aa, Streptococcus mutans
MKKPYSIGLDIGTNSVGWAVVTDDYKVPAKKMKVLGNTDKSHIEKNLLGALLFDSGNTAEDRRLKRTARRRYTRRRNRILYLQEIFSEEMGKVDDSFFHRLEDSFLVTEDKRGERHPIFGNLEEEVKYHENFPTIYHLRQYLADNPEKVDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDTYEEELEVLLAQIGDNYAELFLSAKKLYDSILLSGILTVTDVGTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKLLTFRIPYYVGPLARGKSDFAWLSRKSADKITPWNFDEIVDKESSAEAFINRMTNYDLYLPNQKVLPKHSLLYEKFTVYNELIKVKYKTEQGKTAFFDANMKQEIFDGVFKVYRKVTKDKLMDFLEKEFDEFRIVDLTGLDKENKVFNASYGTYHDLCKILDKDFLDNSKNEKILEDIVLTLTLFEDREMIRKRLENYSDLLTKEQVKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKSYWSKLLSAKLITQRKFDNLTKAERGGLTDDDKAGFIKRQLVETRQITKHVARILDERFNTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLNKLGGD

SEQ ID NO: 126 - protein, 1345 aa, Streptococcus mutans
MKKPYSIGLDIGTNSVGWAVVTDDYKVPAKKMKVLGNTDKSHIKKNLLGALLFDSGNTAEDRRLKRTARRRYTRRRNRILYLQEIFSEEMGKVDDSFFHRLDESFLTDDDKNFDSYPIFGNKAEEDAYHQKFPTIYHLRKHLADSTEKADLRLVYLALAHMIKFRGHFLIEGELNAENTDVQKLFADFVGVYDRTFDDSHLSEITVDASSILTEKISKSRRLEKLINNYPKEKKNTLFRNLVALSLGLQPNFKTNFKLSEDAKLQFSKDTYEEDLEELLGKIGDDYADLFTLAKNLYDAILLSGILTADDSSTKAPLSASMIKRYAEHHEDLEKLKEFIKANKPELYHDIFKDETKNGYAGYIENGVKQDEFYKYLKNTLSKIAGSDYFLDKIEREDFLRKQRTFDNGSIPHQIHLQEMHAILRRQGDYYPFLKENQDRIEKILTFRIPYYVGPLARGKSDFAWLSRKSADKITPWNFDEIVDKESSVEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKAFNASYGTYHDLRKILDKDFLDNSKNEKILEDIVLTLTLFEDREMIRKRLKNYSDLLTKEQLKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKSYWSKLLSAKLITQRKFDNLTKGERGGLTDDDKAGFIKRQLVETRQITKHVARILDERFNTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEYISNIKKVLSYPQVNIVKKVEEQTGGFSKESILPKGDSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLSKLGGD

SEQ ID NO: 127 - protein, 1345 aa, Streptococcus mutans
MKKPYSIGLDIGTNSVGWAVVTDDYKVPAKKMKVLGNTDKSHIKKNLLGALLFDSGNTAEDRRLKRTARRRYTRRRNRILYLQEIFSEEMGKVDDSFFHRLEDSFLVTEDKRGERHPIFGNLEEEVKYHENFPTIYHLRQYLADNPEKTDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDIYEEELEVLLAQIGDNYAELFLSAKKLYDSILLSGILTVTDVSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSVEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKAFNASYGTYHDLRKILDKDFLDNSKNEKILEDIVLTLTLFEDREMIRKRLKNYSDLLTKEQLKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKSYWSKLLSAKLITQRKFDNLTKAERGGLTDDDKAGFIKRQLVETRQITKHVARILDERFNTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLNKLGGD

SEQ ID NO: 128 - protein, 1345 aa, Streptococcus mutans
MKKPYSIGLDIGTNSVGWAVVTDDYKVPAKKMKVLGNTDKSHIKKNLLGALLFDSGNTAEDRRLKRTARRRYTRRRNRILYLQEIFSEEMGKVDDSFFHRLEDSFLVTEDKRGERHPIFGNLEEEVKYHENFPTIYHLRQYLADNPEKVDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDTYEEELEVLLAQIGDNYAELFLSAKKLYDSILLSGILTVTDVSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKVFNASYGTYHDLCKILDKDFLDNSKNEKILEDIVLTLTLFEDREMIRKRLENYSDLLTKEQVKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRQNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSEDVVRKMKSYWSKLLSAKLITQRKFDNLTKAERGGLTDDDKAGFIKRQLVETRQITKHVARILDERFYTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLSKLGGD

SEQ ID NO: 129 - protein, 1345 aa, Streptococcus mutans
MKKPYSIGLDIGTNSVGWAVVTDDYKVPAKKMKVLGNTDKSHIKKNLLGALLFDSGNTAEDRRLKRTARRRYTRRRNRILYLQEIFSEEMGKVDDSFFHRLEDSFLVTEDKRGERHPIFGNLEEEVKYHENFPTIYHLRQYLADNPEKVDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDTYEEDLEELLGKIGDDYADLFTLAKNLYDAILLSGILTADDSSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKVFNASYGTYHDLCKILDKDFLDNSKNEKILEDIVLTLTLFEDREMIRKRLENYSDLLTKEQVKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKSYWSKLLSAKLITQRKFDNLTKAERGGLTDDDKAGFIKRQLVETRQITKHVARILDERFYTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLSKLGGD

SEQ ID NO: 130 - protein, 1345 aa, Streptococcus mutans
MKKPYSIGLDIGTNSVGWAVVTDDYKVPAKKMKVLGNTDKSHIKKNLLGALLFDSGNTAEDRRLKRTARRRYTRRRNRILYLQEIFSEEMGKVDDSFFHRLEDSFLVTEDKRGERHPIFGNLEEEVKYHENFPTIYHLRQYLADNPEKVDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDTYEEDLEELLGKIGDDYADLFTLAKNLYDAILLSGILTADDSSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKVFNASYGTYHDLCKILDKDFLDNSKNEKILEDIVLTLTLFEDREMIRKRLENYSDLLTKEQVKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKPYWSKLLSAKLITQRKFDNLTKAERGGLTDDDKAGFIKRQLVETRQITKHVARILDERFNTETDENNKKIRQVKIVTLKSNLVSNFRKEFELYKVREINDYHHAHDAYLNAVIGKALLGVYPQLEPEFVYGDYPHFHGHEENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLSKLGGD

SEQ ID NO: 131 - protein, 1345 aa, Streptococcus mutans
MKKPYSIGLDIGTNSVGWAVVTDDYKVPAKKMKVLGNTDKSHIKKNLLGALLFDSGNTAEDRRLKRTARRRYTRRRNRILYLQEIFSEEMGKVDDSFFHRLEDSFLVTEDKRGERHPIFGNLEEEVKYHENFPTIYHLRQYLADNPEKVDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDTYEEELEVLLAQIGDNYAELFLSAKKLYDSILLSGILTVTDVSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKVFNASYGTYHDLCKILDKDFLDNSKNEKILEDIVLTLTLFEDREMIRKRLENYSDLLTKEQVKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTKQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKSYWSKLLSAKLITQRKFDNLTKAERGGLTDDDKAGFIKRQLVETRQITKHVARILDERFYTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLSKLGGD

SEQ ID NO: 132 - protein, 1345 aa, Streptococcus mutans
MKKPYSIGLDIGTNSVGWAVVTDDYKVPAKKMKVLGNTDKSHIKKNLLGALLFDSGNTAADRRLKRTARRRYTRRRNRILYLQEIFAEEMSKVDDSFFHRLEDSFLVTEDKRGERHPIFGNLEEEVKYHENFPTIYHLRQYLADNPEKVDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDTYEEELEVLLTQIGDNYAELFLSAKKLYDSILLSGILTVTDVSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKAFNASYGTYHDLRKILDKDFLDNSKNEKILEDIVLTLTLFEDREMIRKRLENYSDLLTKEQVKKLERRHYTGWGRLSAELIHGIRNKESRKTLLDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKPYWSKLLSAKLITQRKFDNLTKAERGGLTDDDKAGFIKRQLVETRQITKHVARILDERFNTETDENNKKIRQVKIVTLKSNLVSNFRKEFELYKVREINDYHHAHDAYLNAVIGKALLGVYPQLEPEFVYGDYPHFHGHEENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELSSSFINLLTFTAIGAPAAFKFFDKNIDRKRYTSTTEILNATLIHQSITGLYETRIDLSKLGGD

SEQ ID NO: 133 - protein, 1345 aa, Streptococcus mutans
MKKPYSIGLDIGTNSVGWAVVTDDYKVPAKKMKVLGNTDKSHIKKNLLGALLFDSGNTAEDRRLKRTARRRYTRRRNRILYLQEIFSEEMGKVDDSFFHRLEDSFLVTEDKRGERHPIFGNLEEEVKYHENFPTIYHLRQYLADNPEKVDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDTYEEELEVLLAQIGDNYAELFLSAKKLYDSILLSGILTVTDVSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKVFNASYGTYHDLCKILDKDFLDNSKNEKILEDIVLTLTLFEDREMIRKRLENYSDLLTKEQVKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTKQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKSYWSKLLSAKLITQRKFDNLTKAERGGLTDDDKAGFIKRQLVETRQITKHVARILDERFYTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDRNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLSKLGGD

SEQ ID NO: 134 - protein, 1336 aa, Streptococcus mutans
MKKSYSIGLDIGTNSVGWAVVTDDYKVPAKKMKVLGNTDKSHIKKNLLGALLFDSGNTAEDRRLKRTARRRYTRRRNRILYLQEIFSEEMGKVDDSFFHRLDESFLTDDDKNFDSHPIFGNKAEEDAYHQKFPTIYHLRKHLADSTEKADLRLVYLALAHMIKFRGHFLIEGELNAENTDVQKLFADFVGVYDRTFDDSHLSEITVDASSILTEKISKSRRLEKLINNYPKEKKNTLFGNLIALSLGLQPNFKTNFKLSEDAKLQFSKDTYEEDLEELLGKIGDDYADLFTLAKNLYDAILLSGILTADDSSTKAPLSASMIKRYAEHHEDLEKLKEFIKANKPELYHDIFKDETKNGYAGYIENGVKQDEFYKYLKNTLSKIAGSDYFLDKIEREDFLRKQRTFDNGSIPHQIHLQEMHAILRRQGDYYPFLKENQDRIEKILTFRIPYYVGPLARKNSRFAWAEYHSDEAVMPWNFDQVIDKESSAQAFIEHMTNNDLYLPNEKVLPKHSPLYEKYTVYNELTKIKYVTEIGEAKFFDANLKQEIFDGLFKHERKVTKKKLRTFLDKNFDEFRIVDIQGLDKETETFNASYATYQDLLKVIKDKVFMDNPENAEILENIVLTLTLFEDREMIKQRLAKYADVFDKKVIDQLARRHYTGWGRLSAKLLNGIRDKQSCKTIMDYLIDDAQSNRNLMQLITDDNLTFKDDIVKAQYVDNSDDLHQVVQSLAGSPAIKKGILQSLKIVDELVKVMGKEPEQIVVEMARENQTTAKGRRNSQQRYKRLKEAIKDLNHKILKEHPTDNQALQNNRLFLYYLQNGRDMYTGESLDINRLSDYDIDHVIPQAFIKDNSIDNRVLTSSKANRGKSDDVPSEDVVNRMRPFWNKLLSSGLISQRKYNNLTKKELTPDDKAGFIKRQLVETRQITKHVARMLDERFNKEFDDNNKRIRRVKIVTLKSNLVSSFRKEFELYKVREINDYHHAHDAYLNAVVVKALLVKYPKLEPEFVYGEYPKYNSYRERKATQKMFFYSNIMNMFKSKVKLADDQIVERPMIEVNDETGEIAWDKTKHITTVKKVLSYPQVNIVKKVEEQTGGLFDPKSPLEKLVPLKKALNPEKYGGYQKPTTAYPILLIVDTKQLIPISVMDKKRFEQNPVKFLKDKGYQQIEKNNFVKLPKYTLVDIGNGIKRLWASSKEVHKGNQLVVSKKSQDLLYHAHHLDNDYSNEYVKNHYQQFDILFNEITSFSKKCKLGKEHIQKIEEAYSKERDSASIEELADGFIKLLGFTQLGATSPFSFLGIKLNQKQYTGKKDYLEATLIHQSITGLYETRIDLNKLGGD

SEQ ID NO: 135 - protein, 1345 aa, Streptococcus mutans
MKKPYSIGLDIGTNSVGWAVVTDDYKVPAKKMKVLGNTDKSHIKKNLLGALLFDSGNTAADRRLKRTARRRYTRRRNRILYLQEIFAEEMSKVDDSFFHRLEDSFLVTEDKRGERHPIFGNLEEEVKYHENFPTIYHLRQYLADNPEKVDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDTYEEELEVLLAQIGDNYAELFLSAKKLYDSILLSGILTVTDVSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKAFNASYGTYHDLRKILDKDFLDNSKNEKILEDIVLTLTLFEDREMIRKRLENYSDLLTKEQVKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVEHSQLQNDRLFLYYLQNGRDMYTGEELDIDYLSQYDIDHIIPQAFIKDNSIDNRVLTSSKENRGKSDDVPSKNVVRKMKSYWSKLLSAKLITQRKFDNLTKAERGGLTDDDKAGFIKRQLVETRQITKHVARILDERFHTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLSKLGGD

SEQ ID NO: 136 - protein, 1345 aa, Streptococcus mutans
MKKPYSIGLDIGTNSVGWAVVTDDYKVPAKKMKVLGNTDKSHIEKNLLGALLFDSGNTAEDRRLKRTARRRYTRRRNRILYLQEIFSEEMGKVDDSFFHRLEDFFLVTEDKRGERHPIFGNLEEEVKYHENFPTIYHLRQYLADNPEKVDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDTYEEELEVLLAQIGDNYAELFLSAKKLYDSILLSGILTADDSSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQSEFYPFLADNQDRIEKILTFRIPYYVGPLARGKSDFAWLSRKSADKITPWNFDEIVDKESSAEAFINRMTNYDLYLPNQKVLPKHSLLYEKFTVYNELTKVKYKTEQGETAFFDANMKQEIFDGVFKVYRKVTKDKLMDFLEKEFDEFRIVDLTGLDKENKAFNASYGTYHDLRKILDKDFLDNSKNEKILEDIVLTLTLFEDREMIRKRLKNYSDLLTKEQLKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKPYWSKLLSAKLITQRKFDNLTKAERGGLTDDDKAGFIKRQLVETRQITKHVARILDERFNTETDENNKKIRQVKIVTLKSNLVSNFRKEFELYKVREINDYHHAHDAYLNAVIGKALLGVYPQLEPEFVYGDYPHFHGHEENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLSKLGGD

SEQ ID NO: 137 - protein, 1345 aa, Streptococcus mutans
MKKPYSIGLDIGTNSVGWAVVTDDYKVPAKKMKVLGNTDKSHIKKNLLGALLFDSGNTAEDRRLKRTARRRYTRRRNRILYLQEIFSEEMGKVDDSFFHRLDESFLTDDDKNFDSHPIFGNKAEEDAYHQKFPTIYHLRKHLADSTEKADLRLVYLALAHMIKFRGHFLIEGELNAENTDVQKLFADFVGVYDRTFDDSHLSEITVDASSILTEKISKSRRLEKLINNYPKEKKNTLFGNLIALSLGLQPNFKTNFKLSEDAKLQFSKDTYEEELEVLLAQIGDNYAELFLSAKKLYDSILLSGILTVTDVSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSVEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKAFNASYGTYHDLRKILDKDFLDNSKNEKILEDIVLTLTLFEDREMIRKRLKNYSDLLTKEQLKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKSYWSKLLSAKLITQRKFDNLTKGERGGLTDDDKAGFIKRQLVETRQITKHVARILDERFNTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEYISNIKKVLSYPQVNIVKKVEEQTGGFSKESILPKGDSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLSKLGGD

SEQ ID NO: 138 - protein, 1345 aa, Streptococcus mutans
MKKPYSIGLDIGTNSVGWAVVTDDYKVPAKKMKVLGNTDKSHIKKNLLGALLFDSGNTAADRRLKRTARRRYTRRRNRILYLQEIFAEEMSKVDDSFFHRLEDSFLVTEDKRGERHPIFGNLEEEVKYHENFPTIYHLRQYLADNPEKVDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDTYEEELEVLLAQIGDNYAELFLSAKKLYDSILLSGILTVTDVSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKVFNASYGTYHDLCKILDKDFLDNSKNEKILEDIVLTLTLFEDREMIRKRLENYSDLLTKEQVKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTKQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKSYWSKLLSAKLITQRKFDNLTKAERGGLTDDDKAGFIKRQLVETRQITKHVARILDERFYTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLSKLGGD

SEQ ID NO: 139 - protein, 1345 aa, Streptococcus mutans
MKKPYSIGLDIGTNSVGWAVVTDDYKVPAKKMKVLGNTDKSHIKKNLLGALLFDSGNTAADRRLKRTARRRYTRRRNRILYLQEIFAEEMSKVDDSFFHRLEDSFLVTEDKRGERHPIFGNLEEEVKYHENFPTIYHLRQYLADNPEKVDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDTYEEELEVLLAQIGDNYAELFLSAKKLYDSILLSGILTVTDVSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKAFNASYGTYHDLRKILDKDFLDNSKNEKILEDIVLTLTLFEDREMIRKRLENYSDLLTKEQVKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKNVVRKMKSYWSKLLSAKLITQRKFDNLTKAERGGLTDDDKAGFIKRQLVETRQITKHVARILDERFHTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELSSSFINLLTFTAIGAPAAFKFFDKNIDRKRYTSTTEILNATLIHQSITGLYETRIDLSKLGGD

SEQ ID NO: 140 - protein, 1336 aa, Streptococcus mutans
MKKPYSIGLDIGTNSVGWAVVTDDYKVPAKKMKVLGNTDKSHIKKNLLGALLFDSGNTAEDRRLKRTARRRYTRRRNRILYLQEIFAEEMSKVDDSFFHRLDESFLTDDDKNFDSHPIFGNKAEEDAYHQKFPTIYHLRKHLADSTEKADLRLVYLALAHMIKFRGHFLIEGELNAENTDVQKLFADFVGVYDRTFDDSHLSEITVDASSILTEKISKSRRLEKLINNYPKEKKNTLFGNLIALSLGLQPNFKTNFKLSEDAKLQFSKDTYEEDLEELLGKIGDDYADLFTLAKNLYDAILLSGILTADDSSTKAPLSASMIKRYAEHHEDLEKLKEFIKANKPELYHDIFKDETKNGYAGYIENGVKQDEFYKYLKNTLSKITGSDYFLDQIEREDFLRKQRTFDNGSIPHQIHLQEMHAILRRQGDYYPFLKENQDRIEKILTFRIPYYVGPLARKNSRFAWAEYHSDEAVTPWNFDQVIDKESSAQAFIEHMTNNDLYLPNEKVLPKHSPLYEKYTVYNELTKIKYVTEIGEAKFFDANLKQEIFDGLFKHERKVTKKKLRTFLDKNFDEFRIVDIQGLDKETETFNASYATYQDLLKVIKDKVFMDNPENAEILENIVLTLTLFEDREMIKQRLAKYADVFDKKVIDQLARRHYTGWGRLSAKLLNGIRDKQSCKTIMDYLIDDAQSNRNLMQLITDDNLTFKDDIVKAQYVDNSDDLHQVVQSLAGSPAIKKGILQSLKIVDELVKVMGKEPEQIVVEMARENQTTAKGRRNSQQRYKRLKEAIKDLNHKILKEHPTDNQALQNNRLFLYYLQNGRDMYTGESLDINRLSDYDIDHVIPQAFIKDNSIDNRVLTSSKANRGKSDDVPSEDVVNRMRPFWNKLLSSGLISQRKYNNLTKKELTLDDKAGFIKRQLVETRQITKHVARMLDERFNKEFDDNNKRIRRVKIVTLKSNLVSSFRKEFELYKVREINDYHHAHDAYLNAVVVKALLVKYPKLEPEFVYGEYPKYNSYRERKATQKMFFYSNIMNMFKSKVKLADDQIVERPMIEVNDETGEIAWDKTKHITTVKKVLSYPQVNIVKKVEEQTGGLFDPKSPLEKLVPLKKALNPEKYGGYQKPTTAYPILLIVDTKQLIPISVMDKKRFEQNPVKFLKDKGYQQIEKNNFVKLPKYTLVDIGNGIKRLWASSKEVHKGNQLVVSKKSQDLLYHAHHLDNDYSNEYVKNHYQQFDILFNEITSFSKKCKLGKEHIQKIEEAYSKERDFASIEELADGFIKLLGFTQLGATSPFSFLGIKLNQKQYTGKKDYLEATLIHQSITGLYETRIDLSKLGGD

SEQ ID NO: 141 - protein, 1345 aa, Streptococcus mutans
MKKPYSIGLDIGTNSVGWSVVTDDYKVPAKKMKVLGNTDKSHIEKNLLGALLFDSGNTAEDRRLKRTARRRYTRRRNRILYLQEIFSEEMGKVDDSFFHRLEDSFLVTEDKRGERHPIFGNLEEEVKYHENFPTIYHLRQYLADNPEKVDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDTYEEELEVLLAQIGDNYAELFLSAKKLYDSILLSGILTVTDVGTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKLLTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKVFNASYGTYHDLCKILDKDFLDNSKNEKILEDIVLTLTLFEDREMIRKRLENYSDLLTKEQVKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKSYWSKLLSAKLITQRKFDNLTKAERGGLTDDDKAGFIKRQLVETRQITKHVARILDERFNTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRIDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLSKLGGD

SEQ ID NO: 142 - protein, 1345 aa, Streptococcus mutans
MKKPYSIGLDIGTNSVGWAVVTDDYKVPAKKMKVLGNTDKSHIKKNLLGALLFDSGNTAEDRRLKRTARRRYTRRRNRILYLQEIFSEEMGKVDDSFFHRLEDSFLVTEDKRGERHPIFGNLEEEVKYHENFPTIYHLRQYLADNPEKTDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDIYEEELEVLLAQIGDNYAELFLSAKKLYDSILLSGILTVTDVSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSVEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKAFNASYGTYHDLRKILDKDFLDNSKNEKILEDIVLTLTLFEDREMIRKRLKNYSDLLTKEQLKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKNVVRKMKSYWSKLLSAKLITQRKFDNLTKAERGGLTDDDKAGFIKRQLVETRQITKHVARILDERFHTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLSKLGGD

SEQ ID NO: 143 - protein, 1345 aa, Streptococcus mutans
MKKPYSIGLDIGTNSVGWAVVTDDYKVSAKKMKVLGNTDKSHIKKNLLGALLFDSGNTAEDRRLKRTARRRYTRRRNRILYLQEIFAEEMSKVDDSFFHRLEDSFLVTEDKRGERHPIFGNLEEEVKYHENFPTIYHLRQYLADNPEKVDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDTYEEELEVLLAQIGDNYAELFLSAKKLYDSILLSGILTVTDVSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKAFNASYGTYHDLRKILDKDFLDNSKNEKILEDIVLTLTLFEDREMIRKRLENYSDLLTKEQVKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVEHSQLQNDRLFLYYLQNGRDMYTGEELDIDYLSQYDIDHIIPQAFIKDNSIDNRVLTSSKENRGKSDDVPSKNVVRKMKSYWSKLLSAKLITQRKFDNLTKAERGGLTDDDKAGFIKRQLVETRQITKHVARILDERFHTETDENNKKIRQVKIVTLKSNLVSNFRKEFELYKVREINDYHHTHDAYLNAVIGKALLGVYPQLEPEFVYGDYPHFHGHKENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLSKLGGD

SEQ ID NO: 144 - protein, 1345 aa, Streptococcus mutans
MKKPYSIGLDIGTNSVGWAVVTDDYKVPAKKMKVLGNTDKSHIKKNLLGALLFDSGNTAEDRRLKRTARRRYTRRRNRILYLQEIFSEEMGKVDDSFFHRLEDSFLVTEDKRGERHPIFGNLEEEVKYHENFPTIYHLRQYLADNPEKTDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDIYEEELEVLLAQIGDNYAELFLSAKKLYDSILLSGILTVTDVSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSVEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKAFNASYGTYHDLRKILDKDFLDNSKNEKILEDIVLTLTLFEDREMIRKRLKNYSDLLTKEQLKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKSYWSKLLSAKLITQRKFDNLTKAERGGLTDDDKAGFIKRQLVETRQITKHVARILDERFNTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEHISNIKKVLSYPQVNIVKKVEEQTGGFSKESILPKGNSYKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPAAFKFFDKNIDRKRYTSTTEILNATLIHQSITGLYETRIDLSKLGGD

SEQ ID NO: 145 - protein, 1345 aa, Streptococcus mutans
MKKPYSIGLDIGTNSVGWAVVTDDYKVPAKKMKVLGNTDKSHIKKNLLGALLFDSGNTAEDRRLKRTTRRRYTRRRNRILYLQEIFSEEMGKVDDSFFHRLEDSFLVTEDKRGERHPIFGNLEEEVKYHENFPTIYHLRQYLADNPEKTDLRLVYLALAHIIKFRGHFLIEGKFDTRNNDVQRLFQEFLAVYDNTFENSSLQEQNVQVEEILTDKISKSAKKDRVLKLFPNEKSNGCFAEFLKLIVGNQADFKKHFELEEKAPLQFSKDTYEEELEVLLAQIGDNYAELFLSAKKLYDSILLSGILTVTDVSTKAPLSASMIQRYNEHQMDLTQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKLLTFRIPYYVGPLASGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKVFNASYGTYHDLCKILDKDFLDNSKNEKILEDIVLTLTLFEDREMIRKRLENYSDLLTKEQVKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKSYWSKLLSAKLITQRKFDNLTKAERGGLTDDDKAGFIKRQLVETRQITKHVARILDERFNTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLSKLGGD

SEQ ID NO: 146 - protein, 1345 aa, Streptococcus mutans
MKKPYSIGLDIGTNSVGWAVVTDDYKVPAKKMKVLGNTDKSHIKKNLLGALLFDSGNTAEDRRLKRTARRRYTRRRNRILYLQEIFSEEMGKVDDSFFHRLEDSFLVTEDKRGERHPIFGNLEEEVKYHENFPTIYHLRQYLADNPEKTDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDIYEEELEVLLAQIGDNYAELFLSAKKLYDSILLSGILTVTDVSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKAFNASYGTYHDLRKILDKDFLDNSKNEKILEDIVLTLTLFEDREMIRKRLKNYSDLLTKEQLKKLERRHYTGWGRLSAELIHGIRNKESRKTILDYLIDDGNSNRNFMQLINDDALSFKEEIAKAQVIGETDNLNQVVSDIAGSLAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKSYWSKLLSAKLITQRKFDNLTKGERGGLTDDDKAGFIKRQLVETRQITKHVARILDERFNTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEYISNIKKVLSYPQVNIVKKVEEQTGGFFKESILPKGDSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLSKLGGD

SEQ ID NO: 147 - protein, 1345 aa, Streptococcus mutans
MKKPYSIGLDIGTNSVGWAVVTDDYKVPAKKMKVLGNTDKSHIKKNLLGALLFDSGNTAEDRRLKRTARRRYTRRRNRILYLQEIFSEEMGKVNDSFFHRLEDSFLVTEDKRGERHPIFGNLEEEVKYHENFPTIYHLRQYLADNPEKVDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDTYEEELEVLLAQIGDNYAELFLSAKKLYDSILLSGILTVTDVSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKVFNASYGTYHDLCKILDKDFLDNSKNEKILEDIVLTLTLFEDREMIRKRLENYSDLLTKEQVKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTKQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKSYWSKLLSAKLITQRKFDNLTKAERGGLTDDDKAGFIKRQLVETRQITKHVARILDERFYTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEYISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPIAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPAAFKFFDKNIDRKRYTSTTEILNATLIHQSITGLYETRIDLSKLGGD

SEQ ID NO: 148 - protein, 1345 aa, Streptococcus mutans
MKKPYSIGLDIGTNSVGWAVVTDDYKVPAKKMKVLGNTDKSHIKKNLLGALLFDSGNTAEDRRLKRTARRRYTRRRNRILYLQEIFSEEMGKVDDSFFHRLEDSFLVTEDKRGERHPIFGNLEEEVKYHENFPTIYHLRQYLADNPEKTDLRLVYLALAHIIKFGGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDIYEEELEVLLAQIGDNYAELFLSAKKLYDSILLSGILTVTDVSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSVEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKAFNASYGTYHDLRKILDKDFLDNSKNEKILEDIVLTLTLFEDREMIRKRLKNYSDLLTKEQLKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKNVVRKMKSYWSKLLSAKLITQRKFDNLTKAERGGLTDDDKAGFIKRQLVETRQITKHVARILDERFHTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLSKLGGD

SEQ ID NO: 149 - protein, 1345 aa, Streptococcus mutans
MKKPYSIGLDIGTNSVGWAVVTDDYKVPAKKMKVLGNTDKSHIKKNLLGALLFDSGNTAEDRRLKRTARRRYTRRRNRILYLQEIFAEEMMQVDESFFQRLDDSFLVEEDKRGSRYPIFGTLKEEKKYHKEFKTIYHLREKLANSTEKADLRLVYLSLAHMIKFRGHFLIEGQLKAENTNVQALFKDFVEVYDKTVEESHLSEMTVDALSILTEKVSKSRRLENLVECYPTEKKNTLFGNLIALSLGLQPNFKTNFQLSEDAKLQFSKDTYEEDLEGLLGEIGDEYADLFASAKNLYDAILLSGILAVDDNTTKAPLSASMVKRYKEHKEELAAFKRFIKEKLPKKYEEIFKDDTKNGYAGYVGADATEEEFYKYVKGILNKVEGADVWLDKIDREDFLRKQRTFDNGSIPHQIHLQEMHAILRRQGEHYPFLKENQDKIEKILTFRIPYYVGPLVRKGSRFAWAEYKADEKITPWNFDDILDKEKSAEKFITRMTLNDLYLPEEKVLPKHSLLYETFTVYNELTKVKYVNEQGEAKFFDANMKQEIFDHVFKENRKVTKDKLLNYLNKEFEEFRIVNLTGLDKENKVFNSSLGTYHDLRKILNKSFLDNKENEQIIEDIIQTLTLFEDREMIRQRLQKYSDIFTKAQLKKLERRHYTGWGRLSYKLINGIRDKQSNKTILGYLIDDGYSNRNFMQLINDDALSFKEEIAKAQVIGEMDGLNQVVSDIAGSPAIKKGILQSLKIVDELVKVMGHNPANIVIEMARENQTTAKGRRSSQKRYKRLEEAIKDLNHKILKEHPTDNQALQNDRLFLYYLQNGRDMYTEDPLDINRLSDYDIDHIIPQAFIKDNSIDNRVLTRSDKNRGKSDDVPSEEVVHKMKPFWSKLLSAKLITQRKFDNLTKAERGGLTDDDKAGFIKRQLVETRQITKHVARILDERFNTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKGDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLETLLYHAKNIHKVDEPKHLDYVDKHKDEFKELLDVVSNFSKKYTLAEGNLEKIKELYAQNNGEDLKELASSFINLLTFTAIGAPAAFKFFDKNIDRKRYTSTTEILNATLIHQSITGLYETRIDLNKLGGD

SEQ ID NO: 150 - protein, 1345 aa, Streptococcus mutans
MKKPYSIGLDIGTNSVGWAVVTDDYKVPAKKMKVLGNTDKSHIKKNLLGALLFDSGNTAEDRRLKRTARRRYTRRRNRILYLQEIFSEEMDKVDDSFFHRLEDSFLVTEDKRGERHPIFGNLEEEVKYHENFPTIYHLRQYLADNPEKVDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDTYEEELEVLLAQIGDNYAELFLSAKKLYDSILLSGILTVTDVSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKVFNASYGTYHDLCKILDKDFLDNSKNEKILEDIVLTLTLFEDREMIRKRLENYSDLLTKEQVKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTKQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKSYWSKLLSAKLITQRKFDNLTKAERGGLTDDDKAGFIKRQLVETRQITKHVARILDERFYTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLSKLGGD

SEQ ID NO: 151 - protein, 1345 aa, Streptococcus mutans
MKKPYSIGLDIGTNSVGWAVVTDDYKVPAKKMKVLGNTDKSHIKKNLLGALLFDSGNTAEDRRLKRTARRRYTRRRNRILYLQEIFSEEMGKVDDSFFHRLEDSFLVTEDKRGERHPIFGNLEEEVKYHENFPTIYHLRQYLADNPEKVDLRLVYLALAHIIKFRGHFLIEGKFDTRNNDVQKLFQEFLAVYDNTFENSSLQEQNVQVEEILTDKISKSAKKDRVLKLFPNEKSNGRFAEFLKLIVGNQADFKKHFELEEKAPLQLSKDTYEEELEVLLAQIGDNYAELFLSAKKLYDSILLSGILTVTDVSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSVEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKAFNASYGTYHDLRKILDKDFLDNSKNEKILEDIVLTLTLFEDREMIRKRLENYSDLLTKEQVKKLERRHYTGWGRLSAELIHGIRNKESRKTLLDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKSYWSKLLSAKLITQRKFDNLTKAERGGLTDDDKAGFIKRQLVETRQITKHVARILDERFNTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEYISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPIAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLSKLGGD

SEQ ID NO: 152 - protein, 1345 aa, Streptococcus mutans
MKKPYSIGLDIGTNSVGWAVVTDDYKVPAKKMKVLGNTDKSHIKKNLLGALLFDSGNTAEDRRLKRTARRRYTRRRNRILYLQEIFSEEMGKVDDSFFHRLEDSFLVTEDKRGERHPIFGNLEEEVKYHENFPTIYHLRQYLADNPEKTDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDIYEEELEVLLAQIGDNYAELFLSAKKLYDSILLSGILTVTDVSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKAFNASYGTYHDLRKILDKDFLDNSKNEKILEDIVLTLTLFEDREMIRKRLKNYSDLLTKEQLKKLERRHYTGWGRLSAELIHGIRNKESRKTILDYLIDDGNSNRNFMQLINDDALSFKEEIAKAQVIGETDNLNQVVSDIAGSLAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKSYWSKLLSAKLITQRKFDNLTKGERGGLTDDDKAGFIKHQLVETRQITKHVARILDERFNTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEYISNIKKVLSYPQVNIVKKVEEQTGGFFKESILPKGDSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLSKLGGD

SEQ ID NO: 153 - protein, 1345 aa, Streptococcus mutans
MKKPYSIGLDIGTNSVGWAVVTDDYKVPAKKMKVLGNTDKSHIKKNLLGALLFDSGNTAEDRRLKRTARRRYTRRRNRILYLQEIFSEEMGKVDDSFFHRLEDSFLVTEDKRGERHPIFGNLEEEVKYHENFPTIYHLRQYLADNPEKTDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDIYEEELEVLLAQIGDNYAELFLSAKKLYDSILLSGILTVTDVSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKAFNASYGTYHDLRKILDKDFLDNSKNEKILEDIVLTLTLFEDREMIRKRLENYSDLLTKEQVKKLERRHYTGWGRLSAELIHGIRNKESRKTLLDYLIDDGNSNRNFMQLINDDALSFKEEIAKAQVIGETDNLNQVVSDIAGSPAIKKGILQSLKIVDELVKIMGHQPENIVVEMARENQFTNQGQRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKSYWSKLLSAKLITQRKFDNLTKAERGGLTDDDKAGFIKRQLVETRQITKHVARILDERFNTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEYISNIKKVLSYPQVNIVKKVEEQTGGFSKESILPKGDSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPDHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLSKLGGD

SEQ ID NO: 154 - protein, 1345 aa, Streptococcus mutans
MKKPYSIGLDIGTNSVGWAVVTDDYKVPAKKMKVLGNTDKSHIKKNLLGALLFDSGNTAADRRLKRTARRRYTRRRNRILYLQEIFAEEMSKVDDSFFHRLEDSFLVTEDKRGERHPIFGNLEEEVKYHENFPTIYHLRQYLADNPEKVDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDTYEEELEVLLAQIGDNYAELFLSAKKLYDSILLSGILTVTDVSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKAFNASYGTYHDLRKILDKDFLDNSKNEKILEDIVLTLTLFEDREMIRKRLENYSDLLTKEQVKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVKHSQLQNDRLFLYYLQNGRDMYTGEELDIDYLSQYDIDHIIPQAFIKDNSIDNRVLTSSKENRGKSDDVPSKNVVRKMKSYWSKLLSAKLITQRKFDNLTKAERGGLTDDDKAGFIKRQLVETRQITKHVARILDERFHTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLSKLGGD

SEQ ID NO: 155 - protein, 1345 aa, Streptococcus mutans
MKKPYSIGLDIGTNSVGWAVVTDDYKVPDKKMKVLGNTDKSHIKKNLLGALLFDSGNTAEDRRLKRTARRRYTRRRNRILYLQEIFSEEMGKVDDSFFHRLEDSFLVTEDKRGERHPIFGNLEEEVKYHENFPTIYHLRQYLADNPEKTDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDIYEEELEVLLAQIGDNYAELFLSAKKLYDSILLSGILTVTDVSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSVEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKAFNASYGTYHDLRKILDKDFLDNSKNEKILEDIVLTLTLFEDREMIRKRLKNYSDLLTKEQLKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKSYWSKLLSAKLITQRKFDNLTKAERGGLTDDDKAGFIKRQLVETRQITKHVARILDERFYTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLSKLGGD

SEQ ID NO: 156 - protein, 1345 aa, Streptococcus mutans
MKKPYSIGLDIGTNSVGWAVVTDDYKVPAKKMKVLGNTDKSHIKKNLLGALLFDSGNTAADRRLKRTARRRYTRRRNRILYLQEIFAEEMSKVDDSFFHRLEDSFLVTEDKRGERHPIFGNLEEEVKYHENFPTIYHLRQYLADNPEKVDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDTYEEELEVLLAQIGDNYAELFLSAKKLYDSILLSGILTVTDVSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKAFNASYGTYHDLRKILDKDFLDNSKNEKILEDIVLTLTLFEDREMIRKRLENYSDLLTKEQVKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKNVVRKMKSYWSKLLSAKLITQRKFDNLTKAERGGLTDDDKAGFIKRQLVETRQITKHVARILDERFHTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLSKLGGD

SEQ ID NO: 157 - protein, 1345 aa, Streptococcus mutans
MKKPYSIGLDIGTNSVGWAVVTDDYKVPAKKMKVLGNTDKSHIEKNLLGALLFDSGNTAEDRRLKRTARRRYTRRRNRILYLQEIFSEEMGKVDDSFFHRLEDSFLVTEDKRGERHPIFGNLEEEVKYHENFPTIYHLRQYLADNPEKVDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIIGNQADFKKHFELEEKAPLQFSKDTYEEELEVLLAQIGDNYAELFLSAKKLYDSILLSGILTVTDVGTQAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKLLTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKVFNASYGTYHDLCKILDKDFLDNSKNEKILEDIVLTLTLFEDREMIRKRLENYSDLLTKEQVKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKSYWSKLLSAKLITQRKFDNLTKAERGGLTDDDKAGFIKRQLVETRQITKHVARILDERFHTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLNKLGGD

SEQ ID NO: 158 - protein, 1345 aa, Streptococcus mutans
MKKPYSIGLDIGTNSVGWAVVTDDYKVPAKKMKVLGNTDKSHIKKNLLGALLFDSGNTAEDRRLKRTARRRYTRRRNRILYLQEIFSEEMGKVDDSFFHRLEDSFLVTEDKRGERHPIFGNLEEEVKYHENFPTIYHLRQYLADNPEKVDLRLVYLALAHIIKFRGHFLIEGKFDTRNNDVQKLFQEFLAVYDNTFENSSLQEQNVQVEEILTDKISKSAKKDRVLKLFPNEKSNGRFAEFLKLIVGNQADFKKHFELEEKAPLQLSKDTYEEELEVLLAQIGDNYAELFLSAKKLYDSILLSGILTVTDVSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSVEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKAFNASYGTYHDLRKILDKDFLDNSKNEKILEDIVLTLTLFEDREMIRKRLENYSDLLTKEQVKKLERRHYTGWGRLSAELIHGIRNKESRKTLLDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKSYWSKLLSAKLITQRKFDNLTKAERGGLTDDDKAGFIKRQLVETRQITKHVARILDERFNTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEYISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPIAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPAAFKFFDKNIDRKRYTSTTEILNATLIHQSITGLYETRIDLSKLGGD

SEQ ID NO: 159 - protein, 1345 aa, Streptococcus mutans
MKKPYSIGLDIGTNSVGWAVVTDDYKVPAKKMKVLGNTDKSHIKKNLLGALLFDSGNTAEDRRLKRTARRRYTRRRNRILYLQEIFSEEMGKVDDSFFHRLEDSFLVTEDKRGECHPIFGNLEEEVKYHENFPTIYHLRQYLADNPEKTDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDTYEEELEVLLAQIGDNYAELFLSAKKLYDSILLSGILTVTDVSTKAPLSASMIQRYNEHQMDLTQLKQFIRQKLSDKYNEVFSDVSKDGYAGYIDGKTNQEAFYKYLKGLLNKIEGNGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKAFNASYGTYHDLRKILDKDFLDNSKNEKILEDIVLTLTLFEDREMIRKRLENYSDLLTKEQVKKLERRHYTGWGRLSAELIHGIRNKESRKTLLDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKPYWSKLLSAKLITQRKFDNLTKAERGGLTDDDKAGFIKRQLVETRQITKHVARILDERFNTETDENNKKIRQVKIVTLKSNLVSNFRKEFELYKVREINDYHHAHDAYLNAVIGKALLGVYPQLEPEFVYGDYPHFHGHEENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELSSSFINLLTFTAIGAPAAFKFFDKNIDRKRYTSTTEILNATLIHQSITGLYETRIDLSKLGGD

SEQ ID NO: 160 - protein, 1345 aa, Streptococcus mutans
MKKPYSIGLDIGTNSVGWAVVTDDYKVPAKKMKVLGNTDKSHIEKNLLGALLFDSGNTAEDRRLKRTARRRYTRRRNRILYLQEIFSEEMGKVDDSFFHRLEDSFLVTEDKRGERHPIFGNLEEEVKYHENFPTIYHLRQYLADNPEKVDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKVPLQFSKDTYEEELEVLLAQIGDNYAELFLSAKKLYDSILLSGILTVTDVGTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKLLTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKVFNASYGTYHDLCKILDKDFLDNSKNEKILEDIVLTLTLFEDREMIRKRLENYSDLLTKEQVKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKSYWSKLLSAKLITQRKFDNLTKAERGGLTDDDKAGFIKRQLVETRQITKHVARILDERFNTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLNKLGGD

SEQ ID NO: 161 - protein, 1345 aa, Streptococcus mutans
MKKPYSIGLDIGTNSVGWAVVTDDYKVPAKKMKVLGNTDKSHIKKNLLGALLFDSGNTAEDRRLKRTARRRYTRRRNRILYLQEIFSEEMGKVDDSFFHRLEDSFLVTEDKRGERHPIFGNLEEEVKYHENFPTIYHLRQYLADNPEKTDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDIYEEELEVLLAQIGDNYAELFLSAKKLYDSILLSGILTVTDVSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKAFNASYGTYHDLRKILDKDFLDNSKNEKILEDIVLTLTLFEDREMIRKRLKNYSDLLTKEQLKKLERRHYTGWGRLSAELIHGIRNKESRKTILDYLIDDGNSNRNFMQLINDDALSFKEEIAKAQVIGETDNLNQVVSDIAGSLAIKKGILQNLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKSYWSKLLSAKLITQRKFDNLTKGERGGLTDDDKAGFIKRQLVETRQITKHVARILDERFNTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEYISNIKKVLSYPQVNIVKKVEEQTGGFFKESILPKGDSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLSKLGGD

SEQ ID NO: 162 - protein, 1345 aa, Streptococcus mutans
MKKPYSIGLDIGTNSVGWAVVTDDYKVPAKKMKVLGNTDKSHIEKNLLGALLFDSGNTAEDRRLKRTARRRYTRRRNRILYLQEIFSEEMGKVDDSFFHRLEDSFLVTEDKRGERHPIFGNLEEEVKYHENFPTIYHLRQYLADNPEKVDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDTYEEELEVLLAQIGDNYAELFLSAKKLYDSILLSGILTVTDVGTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKLLTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKVFNASYGTYHDLCKILDKDFLDNSKNEKILEDIVLTLTLFEDREMIRKRLENYSDLLTKEQVKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKSYWSKLLSAKLITQRKFDNLTKAERGGLTDDDKAGFIKRQLVETRQITKHVARILDERFNTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKSKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLNKLGGD

SEQ ID NO: 163 - protein, 1336 aa, Streptococcus mutans
MKKPYSIGLDIGTNSVGWAVVTDDYKVPAKKMKVLGNTDKSHIKKNLLGALLFDSGNTAEDRRLKRTARRRYTRRRNRILYLQEIFAEEMSKVDDSFFHRLDESFLTDDDKNFDSHPIFGNKAEEDAYHQKFPTIYHLRKHLADSTEKADLRLVYLALAHMIKFRGHFLIEGELNAENTDVQKLFADFVGVYDRTFDDSHLSEITVDASSILTEKISKSRRLEKLINNYPKEKKNTLFGNLIALSLGLQPNFKTNFKLSEDAKLQFSKDTYEEDLEELLGKIGDDYADLFTLAKNLYDAILLSGILTADDSSTKAPLSASMIKRYAEHHEDLEKLKEFIKANKPELYHDIFKDETKNGYAGYIENGVKQDEFYKYLKNTLSKITGSDYFLDQIEREDFLRKQRTFDNGSIPHQIHLQEMHAILRRQGDYYPFLKENQDRIEKILTFRIPYYVGPLARKNSRFAWAEYHSDEAVTPWNFDQVIDKESSAQAFIEHMTNNDLYLPNEKVLPKHSPLYEKYTVYNELTKIKYVTEIGEAKFFDANLKQEIFDGLFKHERKVTKKKLRTFLDKNFDEFRIVDIQGLDKETETFNASYATYQDLLKVIKDKVFMDNPENAEILENIVLTLTLFEDREMIKQRLAKYADVFDKKVIDQLARRHYTGWGRLSAKLLNGIRDKQSCKTIMDYLIDDAQSNRNLMQLITDDNLTFKDDIVKAQYVDNSDDLHQVVQSLAGSPAIKKGILQSLKIVDELVKVMGKEPEQIVVEMARENQTTAKGRRNSQQRYKRLKEAIKDLNHKILKEHPTDNQALQNNRLFLYYLQNGRDMYTGESLDINRLSDYDIDHVIPQAFIKDNSIDNRVLTSSKANRGKSDDVPSEDVVNRMRPFWNKLLSSGLISQRKYNNLTKKELTLDDKAGFIKRQLVETRQITKHVARMLDERFNKEFDDNNKRIRRVKIVTLKSNLVSSFRKEFELYKVREINDYHHAHDAYLNAVVVKALLVKYPKLEPEFVYGEYLKYNSYRERKATQKMFFYSNIMNMFKSKVKLADDQIVERPMIEVNDETGEIAWDKTKHITTVKKVLSYPQVNIVKKVEEQTGGLFDPKSPLEKLVPLKKALNPEKYGGYQKPTTAYPILLIVDTKQLIPISVMDKKRFEQNPVKFLKDKGYQQIEKNNFVKLPKYTLVDIGNGIKRLWASSKEVHKGNQLVVSKKSQDLLYHAHHLDNDYSNEYVKNHYQQFDILFNEITSFSKKCKLGKEHIQKIEEAYSKERDFASIEELADGFIKLLGFTQLGATSPFSFLGIKLNQKQYTGKKDYLEATLIHQSITGLYETRIDLSKLGGD

SEQ ID NO: 164 - protein, 1345 aa, Streptococcus mutans
MKKPYSIGLDIGTNSVGWAVVTDDYKVPAKKMKVLGNTDKSHIKKNLLGALLFDSGNTAADRRLKRTARRRYTRRRNRILYLQEIFAEEMSKVDDSFFHRLEDSFLVTEDKRGERHPIFGNLEEEVKYHENFPTIYHLRQYLADNPEKVDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDTYEEELEVLLAQIGDNYAELFLSAKKLYDSILLSGILTVTDVSTKAPLSASMIQRYNEHQMDLVQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKAFNASYGTYHDLRKILDKDFLDNSKNEKILEDIVLTLTLFEDREMIRKRLENYSDLLTKEQVKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVEHSQLQNDRLFLYYLQNGRDMYTGEELDIDYLSQYDIDHIIPQAFIKDNSIDNRVLTSSKENRGKSDDVPSKNVVRKMKSYWSKLLSAKLITQRKFDNLTKAERGGLTDDDKAGFIKRQLVETRQITKHVARILDERFHTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLSKLGGD

SEQ ID NO: 165 - protein, 1345 aa, Streptococcus mutans
MKKPYSIGLDIGTNSVGWAVVTDDYKVPAKKMKVLGNTDKSHIKKNLLGALLFDSGNTAEDRRLKRTTRRRYTRRRNRILYLQEIFSEEMGKVDDSFFHRLEDSFLVTEDKRGERHPIFGNLEEEVKYHENFPTIYHLRQYLADNPEKTDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDTYEEELEVLLAQIGDNYAELFLSAKKLYDSILLSGILTVTDVSTKAPLSASMIQRYNEHQMDLTQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKLLTFRIPYYVGPLASGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKVFNASYGTYHDLCKILDKDFLDNSKNEKILEDIVLTLTLFEDREMIRKRLENYSDLLTKEQVKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKSYWSKLLSAKLITQRKFDNLTKAERGGLTDDDKAGFIKRQLVETRQITKHVARILDERFNTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLSKLGGD

SEQ ID NO: 166 - protein, 1336 aa, Streptococcus mutans
MKKPYSIGLDIGTNSVGWAVVTDDYKVPAKKMKVLGNTDKSHIKKNLLGALLFDSGNTAADRRLKRTARRRYTRRRNRILYLQEIFAEEMNKVDDSFFHRLDESFLTDDDKNFDSHPIFGNKAEEDAYHQKFPTIYHLRKHLADSTEKADLRLVYLALAHMIKFRGHFLIEGELNAENTDVQKLFADFVGVYDRTFDDSHLSEITVDASSILTEKISKSRRLEKLINNYPKEKKNTLFGNLIALSLGLQPNFKTNFKLSEDAKLQFSKDTYEEDLEELLGKIGDDYADLFTLAKNLYDAILLSGILTADDSSTKAPLSASMIKRYAEHHEDLEKLKEFIKANKPELYHDIFKDETKNGYAGYIENGVKQDEFYKYLKNTLSKIAGSDYFLDKIEREDFLRKQRTFDNGSIPHQIHLQEMHAILRRQGDYYPFLKENQDRIEKILTFRIPYYVGPLARKNSRFAWAEYHSDEAVTPWNFDQVIDKESSAQAFIEHMTNNDLYLPNEKVLPKHSPLYEKYTVYNELTKIKYVTEIGEAKFFDANLKQEIFDGLFKHERKVTKKKLRTFLDKNFDEFRIVDIQGLDKETETFNASYATYQDLLKVIKDKVFMDNPENAEILENIVLTLTLFEDREMIKQRLAKYADVFDKKVIDQLARRHYTGWGRLSAKLLNGIRDKQSCKTIMDYLIDDAQSNRNLMQLITDDNLTFKDDIVKAQYVDNSDDLHQVVQSLAGSPAIKKGILQSLKIVDELVKVMGKEPEQIVVEMARENQTTAKGRRNSQQRYKRLKEAIKDLNHKILKEHPTDNQALQNNRLFLYYLQNGRDMYTGESLDINRLSDYDIDHVIPQAFIKDNSIDNRVLTSSKANRGKSDDVPSEDVVNRMRPFWNKLLSSGLISQRKYNNLTKKELTLDDKAGFIKRQLVETRQITKHVARMLDERFNKEFDDNNKRIRRVKIVTLKSNLVSSFRKEFELYKVREINDYHHAHDAYLNAVVVKALLVKYPKLEPEFVYGEYPKYNSYRERKATQKMFFYSNIMNMFKSKVKLADDQIVERPMIEVNDETGEIAWDKTKHITTVKKVLSYPQVNIVKKVEEQTGGLFDPKSPLEKLVPLKKALNPEKYGGYQKPTTAYPILLIVDTKQLIPISVMDKKRFEQNPVKFLKDKGYQQIEKNNFVKLPKYTLVDIGNGIKRLWASSKEVHKGNQLVVSKKSQDLLYHAHHLDNDYSNEYVKNHYQQFDILFNEITSFSKKCKLGKEHIQKIEEAYSKERDSASIEELADGFIKLLGFTQLGATSPFSFLGIKLNQKQYTGKKDYLEATLIHQSITGLYETRIDLSKLGGD

SEQ ID NO: 167 - protein, 1345 aa, Streptococcus mutans
MKKPYSIGLDIGTNSVGWAVVTDDYKVPAKKMKVLGNTDKSHIKKNLLGALLFDSGNTAADRRLKRTARRRYTRRRNRILYLQEIFAEEMSKVDDSFFHRLEDSFLVTEDKRGERHPIFGNLEEEVKYYENFPTIYHLRQYLADNPEKVDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDTYEEDLEELLGKIGDDYADLFTLAKNLYDAILLSGILTADDSSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKVFNASYGTYHDLCKILDKDFLDNSKNEKILEDIVLTLTLFEDREMIRKRLENYSDLLTKEQVKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKPYWSKLLSAKLITQRKFDNLTKAERGGLTDDDKAGFIKRQLVETRQITKHVARILDERFNTETDENNKKIRQVKIVTLKSNLVSNFRKEFELYKVREINDYHHAHDAYLNAVIGKALLGVYPQLEPEFVYGDYPHFHGHEENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLSKLGGD

SEQ ID NO: 168 - protein, 1345 aa, Streptococcus mutans
MKKPYSIGLDIGTNSVGWAVVTDDYKVPAKKMKVLGNTDKSHIKKNLLGALLFDSGNTAEDRRLKRTTRRRYTRRRNRILYLQEIFSEEMGKVDDSFFHRLEDSFLVTEDKRGERHPIFGNLEEEVKYHENFPTIYHLRQYLADNPEKTDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDTYEEELEVLLAQIGDNYAELFLSAKKLYDSILLSGILTVTDVSTKAPLSASMIQRYNEHQMDLTQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKLLTFRIPYYVGPLASGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKVFNASYGTYHDLCKILDKDFLDNSKNEKILEDIVLTLTLFEDREMIRKRLENYSDLLTKEQVKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKSYWSKLLSAKLITQRKFDNLTKAERGGLTDDDKAGFIKRQLVETRQITKHVARILDERFNTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILKATLIHQSITGLYETRIDLSKLGGD

SEQ ID NO: 169 - protein, 1338 aa, Streptococcus mutans
MDLIGTNSVGWAVVTDDYKVPAKKMKVLGNTDKSHIKKNLLGALLFDSGNTAADRRLKRTARRRYTRRRNRILYLQEIFAEEMSKVDDSFFHRLEDSFLVTEDKRGERHPIFGNLEEEVKYHENFPTIYHLRQYLADNPEKVDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDTYEEELEVLLAQIGDNYAELFLSAKKLYDSILLSGILTVTDVSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKAFNASYGTYHDLRKILDKDFLDNSKNEKILEDIVLTLTLFEDREMIRKRLENYSDLLTKEQVKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVEHSQLQNDRLFLYYLQNGRDMYTGEELDIDYLSQYDIDHIIPQAFIKDNSIDNRVLTSSKENRGKSDDVPSKNVVRKMKSYWSKLLSAKLITQRKFDNLTKAERGGLTDDDKAGFIKRQLVETRQITKHVARILDERFHTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLSKLGGD

SEQ ID NO: 170 - protein, 1362 aa, Streptococcus oralis
ENKNYSIGLDIGTNSVGWAVITDDYKVPSKKMKVLGNTDKRFIKKNLIGALLFDEGTTAEARRLKRTARRRYTRRKNRLRYLQEIFAEEMSKVDSSFFHRLDDSFLIPEDKKGSKYPIFATLIEEKEYHKQFPTIYHLRKQLADSKEKTDLRLIYLALAHMIKYRGHFLYEDTFDIKNNDIQKIFNEFISIYNNTFEGNSLSGQNVQVEAIFTDKISKSAKRERVLKLFPDEKSTGLFSEFLKLIVGNQADFKKHFDLEEKAPLQFSRDTYDEDLENLLGQIGDDFADLFVAAKKLYDAILLSGILTVTDPSTKAPLSASMIERYENHQKDLATLKQFIKTNLPEKYDEVFSDQSKDGYAGYIDGKTTQESFYKYIKNLLSKFEGADYFLEKIEREDFLRKQRTFDNGSIPHQIHLQEMNAILRRQGEHYPFLKENKEKIEKILTFRIPYYVGPLARGNRDFAWLTRNSDQAIRPWNFEEIVDKASSAESFINKMTNYDLYLPEEKVLPKHSLLYETFAVYNELTKVKFIAEGLRDYQFLDSRQKKDIFYTLFKAEDKRKVTEKDIIQYLHTVDGYDGIELKGIEKQFNASLSTYHDLLKIIKDKEFMDDPNNEEILENIVHTLTIFEDREMIKQRLAQYDSLFDEKVIKALTRRHYTGWGKLSSKLINGIRDKQTGKTILDYLMDDGYNNRNFMQLINDDELSFKEIIKKAQVVGKTDDVKQVVQELPGSPAIKKGILQSIKLVDELVKVMGHEPESIVIEMARENQTTARGKKNSQQRYKRIEDSLKILASKILKEHPTDNIQLQNDRLFLYYLQNGRDMYTGKPLDINQLSSYDIDHIVPQAFIKDDSLDNRVLTSLKDNRGKSDNVPSLEVVEKMKTFWQQLLDSKLISYRKFNNLTKAERGGLDERDKVGFIKRQLVETRQITKHVAQILDARYNTEVNEKDKKNRTVKIITLKSNLVSNFRKEFRLYKIREINDYHHAHDAYLNAVVAKAILKKYPKLEPEFVYGDYQKYDLSKDPKEIEKATEKYFFYSNLLNFFKEEVHYADGTIVKRENIEYSKDTGEIAWNKEKDFATIKKVLSLPQVNIVKKREVQTGGFSKESILPKGNSDKLIPRKTKDILWDTTKYGGFDSPVIAYSILLIADIEKGKAKRLKTVKTLVGITIMEKATFEKSPIAFLENKGYHNVRKENILCLPKYSLFELKNGRRRMLASAKELQKGNEIVLPVHLTTLLYHAKNIHRLDEPEHLEYIQKHRNEFKGLLNLVSEFSQKYVLADANLEKIKNLYADNEQADIEILANSFINLLTFTALGAPAAFKFFGKDVDRKRYTTVSEILNATLIHQSITGLYETRIDLSKLGED

SEQ ID NO: 171 - protein, 1360 aa, Streptococcus oralis
ENKNYSIGLDIGTNSVGWSVITDDYKVPSKKMKVLGNTDKRFIKKNLIGALLFDEGTTAEARRLKRTARRRYTRRKNRLRYLQEIFAEEMSKVDSSFFHRLDDSFLIPEDKRGSKYPIFATLAEEKEYHKQFPTIYHLRKQLADSKEKTDLRLIYLALAHMIKYRGHFLYEDTFDIKNNDIQKIFSEFISIYDNTFEGSSLSGQNAQVEAIFTDKISKSAKRERVLKLFPDEKSTGLFSEFLKLIVGNQADFKKHFDLGEKAPLQFSKDTYDEDLENLLGQIGDDFADLFLVAKKLYDAILLSGILTVTDPSTKAPLSASMIERYENHQKDLAVLKQFIKNNLPEKYDEVFSDQSKDGYAGYIDGKTTQEAFYKYIKNLLSKFEGTDYFLEKIEREDFLRKQRTFDNGSIPHQIHLQEMNAILRRQGEHYPFLKDNKEKIEKILTFRIPYYVGPLARGNRDFAWLTRNSDEAIRPWNFEEIVDKASSAEDFINKMTNYDLYLPEEKVLPKHSLLYETFAVYNELTKVKFIAEGLRDYQFLDSGQKKQIVTQLFKEKRKVTEKDIIQFLHNVDGYDGIELKGIEKQFNASLSTYHDLLKIIKDKEFMDDSKNEEILENIVHTLTIFEDREMIKQRLAQYDSLFDEKVIKALIRRHYTGWGKLSAKLIDGICDKQTGNTILDYLIDDGKNNRNFMQLINDDGLSFKEITQKAQVVGKTDDVKQVVQELPGSPAIKKGILQSIKIVDELVKVMGHTPESIVIEMARENQTTARGKKNSQQRYKRIEDALKNLASNILKEHPTNNIQLQNDRLFLYYLQNGRDMYTGKPLDINQLSSYDIDHIVPQAFIKDDSLDNRVLTSLKDNRGKSDNVPSIEVVQKRKAFWQQLLDSKLISERKFNNLTKAERGGLDERDKVGFIKRQLVETRQITKHVAQILDARFNKEVNEKDKKNRTVKIITLKSNLVSNFRKEFRLYKVREINDYHHAHDAYLNAVVAKAILKKYPKLEPEFVYGDYQKYDLSRNPKEVEKATEKYFFYSNLLNFFKEEVHYADGTIVKRENIEYSKDTGEIAWNKEKDFATIKKVLSYPQVNIVKKREVQTGGFSKESILPKGNSDKLIPRKTKDILWETTKYGGFDSPVIAYSILLIADIEKGKAKKLKTVKTLVGITIMEKAAFEENPITFLENKGYHNVRKENILCLPKYSLFELENGRRRLLASAKELQKGNEIVLPVYLTTLLYHSKNVHKLDEPEHLEYIQKHRNEFKDLLNLVSEFSQKYVLADANLEKIQNLYADNEQADIEILANSFINLLTFTALGAPAAFKFFGKDIDRKRYTTVSEILNATLIHQSITGLYETRIDLSKLGED

SEQ ID NO: 172 - protein, 1358 aa, Streptococcus parasanguinis
KKPYSIGLDIGTNSVGWAVITDDYKVPAKKMKVLGNTNKESIKKNLIGALLFDAGNTAADRRLKRTARRRYTRRRNRILYLQEIFAAEMNKVDESFFHRLDDSFLVPEDKRGSKYPIFGTLEEEKEYHKQFPTIYYLRKILADSKEKVDLRLIYLALAHIIKYRGHFLYEDSFDIKNNDIQKIFNEFTILYDNTFEESSLSKGNAQVEEIFTDKISKSAKRDRVLKLFPDEKSTGLFSEFLKLIVGNQADFKKHFDLEEKAPLQFSKDTYEEDLESLLGQIGDVYADLFVVAKKLYDAILLAGILSVKDPGTKAPLSASMIERYDNHQNDLSALKQFVRRNLPEKYAEVFSDDSKDGYAGYIDGKTTQEGFYKYIKNLISKIEGAEYFLEKIEREDFLRKQRTFDNGSIPHQIHLQEMNAILRHQGEYYPFLKENKDKIEQILTFRIPYYVGPLARGNSDFAWLSRNSDEAIRPWNFEEMVDKSSSAEDFIHRMTNYDLYLPEEKVLPKHSLLYETFTVYNELTKVKYIAEGMKDYQFLDSGQKKQIVNQLFKEKRKVTEKDIIHYLHNVDGYDGIELKGIEKHFNSSLSTYHDLLKIIKDKEFMDDPKNEEIFENIVHTLTIFEDRVMIKQRLNQYDSIFDEKVIKALTRRHYTGWGKLSAKLINGIRDKKTSKTILDYLIDDGYSNRNFMQLINDDGLSFKETIQKAQVVGETNDVKQVVQELPGSPAIKKGILQSIKIVDELVKVMGHAPESVVIEMARENQTTNKGKSKSQQRLKTLSDAISELGNILKEHPTDNIQLQNDRLFLYYLQNGKDMYTGEALDINQLSNYDIDHIIPQAFIKDDSLDNRVLTSSKDNRGKSDNVPSLEIVEKMKGFWQQLLDSKLISERKFNNLTKAERGGLDERDKVGFIKRQLVETRQITKHVAQILDDRFNAEVNEKNQKLRSVKIITLKSNLVSNFRKEFGLYKVREINDYHHAHDAYLNAVVAKAILKKYPKLEPEFVYGDYQKYDLTKDPKEIEKATEKYFFYSNLLNFFKDKVYYADGTIIQRGNVEYSKDTGEIAWNKKRDFAIVRKVLSYPQVNIVKKTEEQTGGFSKESILPKGNSDKLIPRKTKNVQLDTTKYGGFDSPVIAYSILLVADVEKGKSKKLKTVKSLIGITIMEKVKFEANPVAFLEGKGYQNVVEENIIRLPKYSLFELENGRRRMLASAKELQKGNEMVLPSYLIALLYHAKRIQKKDEPEHLEYIKQHHSEFNDLLNFVSEFSQKYVLAESNLEKIKNLYIDNEQTNMEEIANSFINLLTFTAFGAPAVFKFFGKDIERKRYSTVTEILKATLIHQSLTGLYETRIDLSKLGEE

SEQ ID NO: 173 - protein, 1327 aa, Streptococcus parauberis
MKVLGNTDRQTVKKNMIGTLLFDSGETAEARRLKRTARRRYTRRINRIKYLQSIFDDEMSKIDSAFFQRIKDSFLVPDDKNDDRHPIFGNIKDEVDYHKNYPTIYHLRKKLADSDEKADLRLIYLALAHIIKFRGHFLIEGDLDSQNTDVNALFLKLVDTYNLMFEDDIDTQTIDATVILTEKMSKSRRLENLIAKIPNQKKNTLFGNLISLSLGLTPNFKANFELSEDAKLQISKESFEEDLDNLLAQIGDQYADLFIAAKNLSDAILLSDILTVKGVNTKAPLSASMVQRFNEHQDDLKLLKKLVKVQLPEKYKEIFDIKDKNGYAGYINGKTSQEDFYKYIKPILSKLKGAESLISKLEREDFLRKQRTFDNGSIPHQIHLNELKSIIRRQEKYYPFLKDKQVRIEKIFTFRIPYFVGPLANGNSSFAWVKRRSNESITPWNFEEVVEQEASAKVFIERMTNFDTYLPEEKVLPKHSLLYEMFTVYNELTKVKYQAEGMRKPEFLSSEEKIEIVSNLFKTERKVTVKQLKENYFNKIRCLDSITISGVEDKFNASLGTYHDLLNIIKNQKILDDEQNQDSLEDIVLTLTLFEDEKMIAKRLSKYESIFDPSILKKLKKRHYTGWGRLSQKLINGIRDKQTGKTILDFLIDGQANRNFMQLINDPSLDFASIIKEAQEKTIKSEKLEETIANLAGSPAIKKGILQSVKIVDEVVKVMGYEPSNIVIEMARENQSTQRGINNSRERLRKLEEVHKNIGSKILKEHEISNAQLQSDRVYLYLLQDGKDMYTGKDLDFDRLSQYDIDHIIPQSFIKDNSIDNIVLTSQESNRGKSDNVPYIAIVNKMKSYWQHQLKSGAISQRKFDNLTKAERGGLSEYDKAGFIKRQLVETRQITKHVAQILNNRFNNNVDDSSKNKRPVKIITLKSKMVSDFRKEFGFYKIREVNDYHHAHDAYLNAVVGTALLKKYPKLEAEFVYGDYKHYDLSDTSLGKATAKMFFYSNIMNFFKKEVRLADGTVITRPQIETNTETGEIVWDKVKDIKTIRKVLSIPQINVVKKTEVQTGGFSKESILSKRDSDKLIPRKNNWDPKKYGGFGSPIIAYSVLVVAKVTKGKSQKTKSVKELVGITIMEQNEFEKDRITFLEKKGYQDIQESLIIKLPKFSLFELENGRKRLLASELQKGNELSLPNKYIQFLYLASRYTSFSGKEEDREKHRHFVESHLHYFDEIKDIIADFSRRYILADANLEKILTLYNEKNQFSIEEQATNMLNLFTFTGLGAPATLKFFNVDIDRKRYTSSTEILNSTLIRQSITGLYETRIDLSKIGGD

SEQ ID NO: 174 - protein, 1355 aa, Streptococcus phocae
KKSYSIGLDIGTNSVGWAVITDDYKVPAKKMKVLGNTSRQSIKKNMIGALLFDEGGPAASTRVKRTTRRRYTRRKNRLCYLRDIFESEMHTIDKHFFLRLEDSFLHKSDKRYEAHPIFGTLQEEKAYHDNYPTIYHLRKALADNTEKADLRLIYLALAHIIKFRGHFLIEGALSANNTDVQQLVHALVDAYNIMFEEDLDIEAIDVKAILTEKISKTRRLENLISNIPGQKKNGLFGNLIALSLGLTPNFKSHFNLPEDAKLQLAKDTYDEELNNLLTQIGDEYADLFLSAKNLSDAILLSDILTVNGDGTQAPLSASLIKRYEEHRQDLALLKQMFKEQLPDLYRDVFTDENKDGYAGYISGKTSQEAFYKYIKPILETLDGAEDFLTKINREDFLRKQRTFDNGSIPHQIHLGELQAILERQQAYYPFLKDNQEKIEKILTFRIPYYIGPLARGNSRFAWLTRTSDQKITPWNFDEMVDQEASAQAFIERMTNFDEYLPQEKVLPKHSLTYEYFTVYNELTKVKYVTEGMTKPEFLSAGQKEQIVELLFKKYRKVTVKQLKEDFFSKIECFDTVDISGVEDKFNASLGTYHDLLKIIKDKAFLDNSENENIIEDIILTLTLFEDKEMIANRLAVYEDLFDQNVLKQLKRRHYTGWGRLSKQLINGMRDKHTGKTILDFLKDGFINRNFMQLINDDNLSFKEEIKKAQEGGLKDSINDQIRDLAGSPAIKKGILQTINIVDEIVKIMGKAPQHIVVEMARDVQKTDIGVKQSRERMKRVQEVLKKLGSQLLKEHPVENFQLQNERLYLYYLQNGKDMYTGEELSISNLSHYDIDHIIPRSFIKDDSIDNKVLTRSEHNRGKTDNVPSIEVVKRMKPYWQKLLDTKVISQRKFDNLTKAERGGLQESDKANFIQRQLVETRQITKHVAQILDSRFNTERDEKDRPIRRVKVITLKSKFVSDFRQDFGFYKLREINDYHHAHDAYLNAVVGTALLKMYPKLASEFVYGDYQKYDLSGKASGHATAKYFFYSNLMNFFKSEVKLANGNIIKRSPIEVNEETGEIVWDKTKDFGTVRKVLSAPQVNIVKKTEIQTGGFSNETILSKGKSSKLIPRKNKWRDTTKYGGFNTPTVAYSVLVVAKVEKGKAKKLKPVKELVGITIMERTKFEANPIAFLESKGYHDIQEHLMITLPKYSLFELENGRRRLLASELQKGNEMVLPQHLVTFLYRVSKRDKGTQSENMEYISNHKEKFIEIFHYIIRYAEKNVIKPKVIERLNDTFNQKFNDSDLTELSISFLNLFKFTSFGAPEKFTFLNSEIKQDDVRYRSTKECLNSTLIHQSVTGLYETRIDLSQFGGD

SEQ ID NO: 175 - protein, 1361 aa, Streptococcus pseudopneumoniae
SNKPYSIGLDIGTNSVGWAVITDDYKVPSKKMKVLGNTDKHFIKKNLIGALLFDEGTTAEDRRLKRTARRRYTRRKNRLRYLQEIFSEEISKVDNSFFHRLDDSFLVPEDKRGSKYPIFATLTEEKEYYKQFPTIYHLRKQLADSKEKADLRLIYLTLAHMIKYRGHFLYEESFDIKNNDIQKIFNEFISIYDNTFEGSSLSGQNAQVEAIFTDKISKSTKRERVLKLFPDQKSTGLFSEFLKLIVGNQADFKKHFDLEEKAPLQFSKDTYDEDLENLLGQIGDDFADLFLVAKKLYDAILLSGILTVTDPSTKAPLSASMIERYENHQKDLAALKQFIKNNLPEKYDEVFSDQSKEGYAGYIDSKTTQEAFYKYIKNLLSKIDGADYLLDKIEREDFLRKQRTFDNGSIPHQIHLQEMNAILRRQGEHYPFLKENREKIEKILTFRIPYYVGPLARGNRDFAWLTRNSDQAIRPWNFEEIVDKASSAEAFINKMTNYDLYLPEEKVLPKHSLLYETFAVYNELTKVKFIAEGLRDYQFLDSGQKKKIINQLFKEKRKVTEKDLIHYLHNVDGYDGIELKGIEKQFNASLSTYHDLLKIIKDKRFMDEPKNQEILENIVHTLTIFEDREMIKQRLAQYASIFDEKVIKTLTRRHYTGWGKLSAKLINCIRDRKTGKTILDYLIDDGYNNRNFMQLINDDGLSFKEIIQESQVVGKPDDVKQIVQELPGSSAIKKGILQSIKLVDELVKVMGHDPESIVIEMARENQTTARGKKNSQQRYKRIEDSLKILASNILKEHPTDNIQLQNDRLFLYYLQNGKDMYTGNPLDINHLSSYDIDHIIPQAFIKDDSLDNRVLTSSKDNRGKSDNVPSLEVVQKRKAFWQQLLESKLISERKFNNLTKAERGGLNERDKVGFIKRQLVETRQITKHVAQILDSRFNTKVNEKNQKIRTVKIITLKSNLVSNFRKEFRLYKVREINDYHHAHDAYLNAVVAKAILKKYPKLEPEFVYGDYQKYDLSRDPKEIEKATEKYFFYSNLLNFFKEEVHYADGTIVKRENIEYSKDTGEIAWNKEIDFATIRKILSLSQVNIVKKTEEQTGGLFDNNIVSKKKVVDASKLIPIKSGLSPEKYGGYARPTIAYSVLVIADIEKGKAKKLKRIKEMVGITIQDKKKFEANPTAYLEEYGYKNINPNLIIKLPKYSLFKFNDGQRRLLASSIELQKGNELILPYHFTTLLYHAQRINKISEPIHKQYVETHQSEFEELLTTIISLSKKYIQKPIVESLLQQAFEQADKDIYQLSESFISLLKLTSFGAPGAFRFLGVEISQSNVRYQSVSSCFNATLIHQSITGLYETRIDLSKLGED

SEQ ID NO: 176 - protein, 1361 aa, Streptococcus pseudopneumoniae
SNKPYSIGLDIGTNSVGWVIITDDYKVPSKKMKVLGNTDKHFIKKNLIGALLFDEGTTAEDRRLKRTARRRYTRRKNRLRYLQEIFAEEMNKVDSSFFHRLDDSFLVPEDKRGSKYPIFATLAEEKEYHKNFPTIYHLRKQLADSKEKADLRLIYLALAHMIKYRGHFLYEEAFDIKNNDIQKIFNEFINIYDNTFEGSSLSGQNEQVEAIFSDKISKSAKRERVLKLFPDEKSTGLFSEFLKLIVGNQADFKKHFDLEEKAPLQFSKDTYDEDLENLLGQIGDGFADLFLVAKKLYDAILLSGILTVTDPSTKAPLSASMIERYQNHQNDLASLKQFIKNNLPEKYDEVFSDQSKDGYAGYVDGKTTQEAFYKYIKNLLSKFEGADYFLEKIEREDFLRKQRTFDNGSIPHQIHLQEMNAILRRQGEHYPFLKENKEKIEKILTFRIPYYVGPLARGNRDFAWLTRNSDQAIRPWNFEEIVDKASSAEDFINKMTNYDLYLPEEKVLPKHSLLYETFAVYNELTKVKFIAEGLRDYQFLDSGQKKQIVNQLFKEKRKVTEKDIIQYLHNVDGYDGIELKGIEKQFNASLSTYHDLLKIIKDKEFMDDSKNEEILENIVHTLTIFEDREMIKQRLAQYDSIFDEKVIKALTRRHYTGWGKLSAKLINGIRDKQTGKTILDYLIDDGYSNRNFMQLINDDGLSFKEIIQKAQVFGKTNDVKQVVQELPGSPAIKKGILQSIKIVEELVKVMGHEPESIVIEMARENQTTTRGKKNSQQRYKRIENSLKILASKILKEHPTDNNQLQNDRLFLYYLQNGKDMYTGEALDINQLSSCDIDHIIPQAFIKDDSLDNRVLTSSKENRGKSDNVPCLEVVDKMKVFWQQLLDFKLISYRKFNNLTKAERGGLDERDKVGFIRRQLVETRQITKHVAQILDSRFNTEVTEKDKKNRNVKIITLKSNLVSNFRKEFGLYKVREINDYHHAHDAYLNAVVAKAILKKYPKLEPEFVYGDYQKYDLSKDPKDIEKATEKYFFYSNLLNFFKEEVHYADGTIVKRENIEYSKDTGEIAWNKEKDFATIKKILSLPQVNIVKKTEEQTGGLFDNNIVSKKKVVDASKLIPIKSGLSPEKYGGYARPTIAYSVLVIADIEKGKTKKLKRIKEMIGITVQDKKIFESNPIAYLEECGYKNINPNLIIKLPKYSLFEFNGGQRRLLASSIELQKGNELILPYHFTALLYHTQRINKISEPIHKQYVEAHQNEFKELLTTIISLSKKYIQKPNVESLLQQAFEQADKDIYQLSESFISLLKLTSFGAPGAFKFLGVEISQSSVRYKPNSQFLDATLIHQSITGLYETRIDLSKLGED

SEQ ID NO: 177 - protein, 1363 aa, Streptococcus pseudopneumoniae
SNKPYSIGLDIGTNSVGWAVITDDYKVPSKKMTVLGNTDKHFIKKNLIGALLFDEGTTAEDRRLKRTARRRYTRRKNRLRYLQEIFSGEMSKVDSSFFHRLDDSFLVPEDKRGSKYPIFATLVEEKEYHKQFPTIYHLRKQLADSKEKADLRLIYLVLAHMIKYRGHFLYEEAFDIKNNDIQKIFNEFISIYDNTFEGSSLSGQNAQVETIFTDKISKSAKRERVLKLFPDEKSTGLFSEFLKLIVGNQADFKKHFDLGEKAPLQFSKDTYDEDLENLLGQIGDDFADLFLVAKKLYDAILLSGILTVTDPSTKAPLSASMIERYENHQKDLTTLKQFIKNNLPEKYDEVFSDQSKDGYAGYIDGKTTQEAFYKYIKNLLSKFEGTDYFLEKIEREDFLRKQRTFDNGSIPHQIHLQEMNAILRRQGEHYPFLKENKEKIEKILTFRIPYYVGPLARGNRDFAWLTRNSDQAIRPWNFEEIVDKASSAEDFINKMTNYDLYLPEEKVLPKHSLLYETFAVYNELTKVKFIAEGLRDYQFLDSGQKKQIVNQLFKEKRKVTEKDIIHYLHTVDGYDGIELKGIEKQFNASLSTYHDLLKIIKDKEFMDDSKNEAILENIVHTLTIFEDREMIKQRLAQYDSLFDKKVIKALTRRHYTGWGKLSAKLINGICDKQTGNTILDYLIDDGEINRNFMQLINDDGLSFKKIIQKSQVVGETDDVKQVVRELPGSPAIKKGILQSIKIVDELVKVMDHAPESIVIEMARENQTTARGKKNSQQRYKRIEDSLKILASNILKENPTDNNQLQNDRLFLYYLQNGKDMYTGEALDINQLSSYDIDHIIPQAFIKDDSLDNRVLTSSKDNRGKSDNVPSLEVVQKRKAFWQQLLDSKLISERKFNNLTKAERERDGLNELDKVGFIKRQLVETRQITKHVAQILDARFNKEVTEKDKKNRNVKIITLKSNLVSNFRKEFRLYKVREINDYHHAHDAYLNAVVAKAILKKYPKLEPEFVYGDYQKNDLSKDPKDIEKATEKYFFYSNLLNFFKEEVHYADGTIVKRENIEYSKDTGEIAWNKEKDFATIKKVLSYPQVNIVKKTEEQTGGLFDNNIVSKEKVVDASKLIPIKSGLSPEKYGGYARPTIAYSVLVIADIEKGKTKKLKRIKEMVGITIQDKKKFEANPIAYLEECGYKNINPNLIIKLPKYSLFEFNGGQRRLLASSIELQKGNELILPYHFTALLYHAQRINKFSEPIHKQYVEAHQNEFKELLTIIISLSKKYIQKPNVESLLHQAFEQADNDIYQLSESFISLLKLTSFGAPGAFKFLGAEISQSSVRYKPNSQFLDTTLIHQSITGLYETRIDLSKLGED

SEQ ID NO: 178 - protein, 1360 aa, Streptococcus pseudoporcinus
YSYSIGLDIGTNSVGWAVINEDYKVPAKKMTVFGNTDRKTIKKNLLGTVLFDSGETAQARRLKRTNRRRYTRRRYRLCQLQNIFATEMVKVDDTFFQRLSESFFYYQDKAFDKHPIFGNSKEERAYHKTYPTIYHLRKDLADRDQKADLRLIYLALSHIIKFRGHFLIEGKLNSENTDVQKLFIALVTVYNLLFEEEIAGETCDAKALLTAKTSKSKRLESLISEFPGQKKNGLFGNLLALALGLRPNFKSNFGLSEDAKLQITKDTYEEELDNLLAEIGDHYADLFLAAKNLSDAILLSDILTLSDENTRAPLSASMIKRYEEHQEDLALLKKLVKEQMPEKYWEIFSNAKKNGYAGYIEGKVSQEDFYRYIKPILSRLKGGDEFLAKIDRDDFLRKQRTFDNGSIPHQIHLKELHAILRRQEKYYPFLAEQKEKIEQLLCFRIPYYVGPLAKGGNSSFAWLKRRSDEPITPWNFKDVVDEEASAQAFIEGMTNYDTYLPEEKVLPKHSPLYEMFTVYNELTKVKYIAENMTKPLYLSAEQKEAIIDHLFKQTRKVTVKDLKEKYFSQIEGLENVDVTGVEGAFNASLGTYNDLLKIIKDKAFLDDEANAEILEEIVLILTLFQDEKLIEKRLAKYANLFEKSVLKKLRKRHYRGWGRLSRQLIDGMKDKASGKTILDFLKDDFANRNFIQLINDSSLDFEKLIDDAQKKAIKRESLTEAVANLAGSPAIKKGILQSLKVVDEIVKVMGHNPDNIVIEMSRENQTTAQGLKNARQRLKKIKEVHKKTGSRILEDNSERITNLTLQDNRLYLYLLQDGKDMYTGQDLDINNLSQYDIDHIIPQSFIKDNSIDNLVLTTQKANRGKSDNVPSIEVVRDMKDRVWRRQLANGAISRQKFDHLTKAERGGLADSDKARFLRRQLVETRQITKHVAQLLDSRFNSKSNQNKKLARNVKIITLKSKIVSDFRKDFGLYKLREVNNYHHAHDAYLNAVVGTALLKKYPKLEAEFVYGDYKHFDLSDPSLGKATAKVFFYSNIMNFFKEELSLADGTLMKRPVIETNTETGEVVWDKVKDFKTIRKVLSYPQVNIVKKTEIQSGAFSKESVLSKGNSDKLIERKKGWDPKKYGGFDSPNTAYSIFVVAKVAKRKAQKLKTVKEIVGITIMEQAEYEKDNIAFLEKKGYQDIQEKLLIKLPKYSLFELENGRRRLLASEFQKGNELALSGKYMKFLYLASRYDKLSSKIESEQQKKLFVEQHLHYFDEILDIVVKHATCYIKAENNLKKIISLYKKKEAYSINEQALNMLNLFIFTSLGAPSTFVFFDETIDRKRYTTSSDVLNGILIQQSITGLYETRIDLSRFGGD

SEQ ID NO: 179 - protein, 1316 aa, Streptococcus pseudoporcinus
MLGTVLFDSGETAQARRLKRTNRRRYTRRRYRLCQLQNIFATEMVKVDDTFFQRLSESFFYYQDKAFDKHPIFGNSKEERAYHKTYPTIYHLRKDLADRDQKADLRLIYLALSHIIKFRGHFLIEGKLNSENTDVQKLFIALVTVYNLLFEEEIAGETCDAKALLTAKTSKSKRLESLISEFPGQKKNGLFGNLLALALGLRPNFKSNFGLSEDAKLQITKDTYEEELDNLLAEIGDHYADLFLAAKNLSDAILLSDILTLSDENTRAPLSASMIKRYEEHQEDLALLKKLVKEQMPEKYWEIFSNAKKNGYAGYIEGKVSQEDFYRYIKPILSRLKGGDEFLAKIDRDDFLRKQRTFDNGSIPHQIHLKELHAILRRQEKYYPFLAEQKEKIEQLLCFRIPYYVGPLAKGGNSSFAWLKRRSDEPITPWNFKDVVDEEASAQAFIEGMTNYDTYLPEEKVLPKHSPLYEMFTVYNELTKVKYIAENMTKPLYLSAEQKEAIIDHLFKQTRKVTVKDLKEKYFSQIEGLENVDVTGVEGAFNASLGTYNDLLKIIKDKAFLDDEANAEILEEIVLILTLFQDEKLIEKRLAKYANLFEKSVLKKLRKRHYRGWGRLSRQLIDGMKDKASGKTILDFLKDDFANRNFIQLINDSSLDFEKLIDDAQKKAIKRESLTEAVANLAGSPAIKKGILQSLKVVDEIVKVMGHNPDNIVIEMSRENQTTAQGLKNARQRLKKIKEVHKKTGSRILEDNSERITNLTLQDNRLYLYLLQDGKDMYTGQDLDINNLSQYDIDHIIPQSFIKDNSIDNLVLTTQKANRGKSDNVPSIEVVRDMKDRVWRRQLANGAISRQKFDHLTKAERGGLADSDKARFLRRQLVETRQITKHVAQLLDSRFNSKSNQNKKLARNVKIITLKSKIVSDFRKDFGLYKLREVNNYHHAHDAYLNAVVGTALLKKYPKLEAEFVYGDYKHFDLSDPSLGKATAKVFFYSNIMNFFKEELSLADGTLMKRPVIETNTETGEVVWDKVKDFKTIRKVLSYPQVNIVKKTEIQSGAFSKESVLSKGNSDKLIERKKGWDPKKYGGFDSPNTAYSIFVVAKVAKRKAQKLKTVKEIVGITIMEQAEYEKDNIAFLEKKGYQDIQEKLLIKLPKYSLFELENGRRRLLASEFQKGNELALSGKYMKFLYLASRYDKLSSKIESEQQKKLFVEQHLHYFDEILDIVVKHATCYIKAENNLKKIISLYKKKEAYSINEQALNMLNLFIFTSLGAPSTFVFFDETIDRKRYTTSSDVLNGILIQQSITGLYETRIDLSRFGGD

SEQ ID NO: 180 - protein, 1359 aa, Streptococcus sanguinis
KKPYSIGLDIGTNSVGWAVVTDDYKVPAKKMRVFGDTDRSHIKKNLLGTLLFDDGNTAESRRLKRTARRRYTRRRNRILYLQEIFTESMNEIDESFFHRLDDSFLVPEDKRGSKYPIFATLQEEKEYHKQFPTIYHLRKQLADSKEKSDVRLIYLALAHMIKYRGHFLYEETFDIKNNDIQKIFNEFINIYDNTFEGSSLSGQNAQVEAIFTDKISKSAKRERVLKLFPDEKSTGLFSEFLKLIVGNQADFKKHFDLEEKAPLQFSKDTYDEELENLLGQIGDDFADLFLIAKKLYDAILLSGILTVTDPSTKAPLSASMIERYENHQKDLAALKQFIKNNLPEKYVEVFSDQSKDGYAGYIDGKTTQEAFYKYIKNLLSKFEGADYFLDKIEREDFLRKQRTFDNGSIPHQIHLQEMNAILRRQGEHYPFLKENREKIEKILTFRIPYYVGPLARDNRDFSWLTRNSDEPIRPWNFEEVVDKARSAEDFIHRMTNYDLYLPEEKVLPKHSLLYETFAVYNELTKVKFIAEGLRDYQFLDSGQKKQIVNQLFKEKRKVTEKDIIHYLHNVDGYDGIELKGIEKQFNANLSTYHDLLKITKDKEFMDDPKNEEILENIVHTLTIFEDREMIKQRLAQYDTLFDEKVIKALTRRHYTGWGKLSAKLINGIRDKQSGKTILDYLIDDDKINRNFMQLINDDGLSFKEIIQKAQVVGKTDDVKQVVQELPGSPAIKKGILQSIKIVDELVKVMGYALESIVIEMARENQTTARGKKNSQQRYKRIEDALKNLAPNILKENPTDNIQLKNDRLFLYYLQNGKDMYTGKPLDINQLSSYDIDHIIPQAFIKDDSIDNRVLTSSKDNRGKSDNVPSLEVVQKRKAFWQQLLDSKLISERKFNNLTKAERGGLDERDKVGFIRRQLVETQQITKNVAQILDARFNTEVKEKNQKIRTVKIITLKSNLVSNFRKEFGLYKVREINNYHHAHDAYLNAVVAKAILKKYPKLEPEFVYGDYQKYDLFKPSKEIEKATEKYFFYSNLLNFFKEEVLYADGTIRKRENIEYSKDTGEIAWDKEKDFATIKKVLSYPQVNIVKKREVQTGGFSKESILPKGNSDKLIPRKTKDILWDTTKYGGFDSPVIAYSILLIADIEKGKAKKLKTVKTLVGITIMEKAAFEENPITFLENKGYHNVRKENILCLPKYSLFELENGRRRLLASAKELQKGNEIVLPVCLTTLLYHSKNLHKLDEPEHLEYIQKHRNEFKDLLNLVSEFSQKYILAEANLEKIKDLYADNEQADIEILANSFINLLTFTALGAPAAFKFFGKDVDRKRYTTVSEILNATLIHQSITGLYETRIDLSKLGEE

SEQ ID NO: 181 - protein, 1362 aa, Streptococcus sanguinis
KKPYSIGLDIGTNSVGWAVITDDYKVPSKKMKVLGNTDKHFIKKNLIGALLFDEGTTAEDRRLKRTSRRRYTRRKNRLRYLQEIFSEEISKLDSSFFHRLDDSFLVPEDKRGSKYPIFATLEEEKEYHKKFPTIYHLRKHLADSKEKTDLRLIYLALAHMIKYRGHFLYEESFDIKNNDIQKIFNEFISIYDNTFEGSSLSGQNAQVEAIFTDKISKSTKRERVLKLFSDEKSTGLFSEFLKLIVGNQADFKKHFDLEEKAPLQFSKDTYDEDLENLLGQIGDGFADLFLVAKKLYDAILLSGILTVTDPSTKAPLSASMIERYENHQEDLAALKQFIKNNLSEKYAEVFSDQSKDGYAGFIDGKTTQEAFYKYIKNLLSKLEGADYFLNKIEREDFLRKQRTFDNGSIPHQIHLQEMNAILRRQGEHYLFLKENREKIEKILAFRIPYYVGPLARGNRDFAWLTRNSDQAIRPWNFEEVVDKASSAEDFINKMTNYDLYLPEEKVLPKHSLLYETFAVYNELTKVKFIAEGLRDYQFLDSGQKKQIVNQLFKDKRKVTEKDIIHYLHNVDGYDGIELKGIEKQFNASLSTYHDLLKIIKDKEFMDNPKNGEILENIIHTLTIFEDREMIKQRLAQYDTLFDEKVIKALTRRHYTGWGKLSAKLINGIRDKQTGKTILEYLIDDGDCNRNFMQLINDDGLSFKEIIQKAQVVGKTDDVKQVVQEIPGSPAIKKGILQSIKIVDELVKVMGHNPESIVIEMARENQTTAKGKKNSQQRYKRIEDALKNLAPNILKENPTDNIQLQNDRLFLYYLQNGKDMYTGKAIDINQLSNYDIDHIIPQAFIKDDSLDNRVLTSSKDNRGKSDNVPSIEVVQKRKAFWQQLLDSKLISERKFNNLTKAKRGGLDERDKVGFIKRQLVETRQITKHVAQLLDTRFNTEVNEENQKIRTVKIITLKSNLVSNFRKEFGLYKVREINDYHHAHDAYLNAVVAKAILKKYPKLEPEFVYGDYQKYDLSKASNTIDKATEKYFFYSNLLNFFKEKVRYADGTIKKRENIEYSNDTGEIAWNKEKDFATIKKVLSLPQVNIVKKTEEQTGGLFDNNIVSKKKVVDASKLIPIKSSLSPEKYGGYARPTIAYSVLVIADIEKGKGKAKKLKRIKEIVGITIQDKKKFESNPVTYLEECGYKNINSNLIIKLPKYSLFEFNDGQRRLLASSIELQKGNELILPYHLTALLYHAQRINKISEPIHKQYVEAHQNEFKELLTTIISLSKKYIQKPNVELLLQQAFDQADKDIYQLSESFISLLKLTSFGAPGAFKFLGVEISQSSVRYKPNSQFLDTTLIHQSITGLYETRIDLSKLGED

SEQ ID NO: 182 - protein, 1360 aa, Streptococcus sp. F0441
ENKNYSIGLDIGTNSVGWSVITDDYKVPSKKMKVLGNTDKHFIKKNLIGALLFDEGTTAEARRLKRTARRRYTRRKNRLRYLQEIFSEEIGKVDSSFFHRLDDSFLIPEDKRGSKYPIFATLAEEKKYHKQFPTIYHLRKQLADSKEKTDLRLIYLALAHMIKYRGHFLYEEAFDIKNNDIQKIFNEFISIYNNTFEGNSLSGQNVQVEAIFTDKISKSAKRERVLKLFPDEKSTGLFSEFLKLIVGNQADFKKHFDLEEKAPLQFSRDTYDEDLENLLGQIGDDFADLFLVAKKLYDAILLSGILTVTNPSTKAPLSASMIERYENHQKDLASLKQFIKNNLPEKYDEVFSDQSEDGYAGYIDGKTTQETFYKYIKNLLSKFEGADYFLDKIEREDFLRKQRTFDNGSIPHQIHLQEMNAILRRQGEHYPFLKENKEKIEKILTFRIPYYVGPLARGNRDFAWLTRNSDQAIRPWNFEEIVDKASSAEDFINKMTNYDLYLPEEKVLPKHSLLYETFAVYNELTKVKFIAEGLRDYQFLDSGQKKQIVTQLFKEKRKVTEKDIIQFLHNVDGYDGIELKGIEKQFNASLSTYHDLLKIIKDKAFMDDAKNEAILENIVHTLTIFEDREMIKQRLAQYDSLFDEKVIKALTRRHYTGWGKLSAKLINGISDKQTGNTILDYLIDDGEINRNFMQLINDDGLSFKEIIQKAQVVGKTNDVKQVVQELPGSPAIKKGILQSIKIVDELVKVMGHAPESIVIEMARENQTTARGKKNSQQRYKRIEDSLKILASKILKEHPTDNIQLQNDRLFLYYLQNGKDMYTGEALDINQLSSCDIDHIIPQAFIKDDSLDNRVLTSSKDNRGKSDNVPSLEVVDKMKVFWQQLLDSKLISYRKFNNLTKAERGGLNELDKVGFIKRQLVETRQITKHVAQILDARFNKEVTEKDKKNRTVKIITLKSNLVSNFRKEFELYKVREINDYHHAHDAYLNAVVAKAILKKYPKLEPEFVYGDYQKYDLSKDPKEIEKATEKYFFYSNLLNFFKEEVHYADGTIVKRENIEYSKDTGEIAWNKEKDFATIKKVLSLPQVNIVKKREVQTGGFSKESILPKGNSDKLIPRKTKDILWDTTKYGGFDSPVIAYSILLIADIEKGKAKKLKTVKTLVGITIMEKDAFEKNPIAFLENKGYHNVCKENILCLPKYSLFELENGRRRLLASAKELQKCNEIVLPVYLTTLLYHSKNVHKLDEPGHLEYIQKHRNEFKDLLNLVSEFSQKYVLADANLEKIKNLYADNEQADIEILANSFINLLTFTALGAPAAFKFFGKDVDRKRYTTVSEILNATLIHQSITGLYETRIDLSKLGED

SEQ ID NO: 183 - protein, 1360 aa, Streptococcus sp. FF10
MKKPYSIGLDIGTNSVGWSVVTDDYKVPAKKMKVLGNTDKEYIKKNLIGALLFDSGETAEATRMKRTARRRYTRRRNRILYLQDIFSPELNQVDESFLHRLDDSFLVAEDKRGERHVIFGNIADEVKYHKEFPTIYHLRKHLADSSEKADLRLVYLALAHIIKYRGHFLIDEPIDIRNMNSQNLFKEFLLAFDGIQVDCYLASKHTDISGIITAKISKSRKVEAVLEQFPDQKKNSFFGNMVSLVFGLMPNFKSNFELDEDAKLQFSRDSYDEDLENLLGIIGDEYADVFVAAKKVYDSILLSGILTTNNHSTKAPLSASMIDRYDEHNSDKKLLRDFIRTNIGKEVFKEVFYDTSKNGYAGYIDGKTNQEDFYKYLKNLLQKVDGGDYFIEKIEREDFLRKQRTFDNGSIPHQVHLDEMKAILRRQGEFYPFLKENAEKIQQILTFKIPYYVGPLARGNSRFAWASYNSNEKMTPWNFDNVIDKTSSAQAFIERMTNNDLYLPDQKVLPKHSLLYQKFAVYNELTKIKYVTETGEARLFDVFLKKEIFDGLFKKERKVTKKKILNFLDKNFDEFRITDIQGLDNETGNFNASYGTYHDLLKIIGDKEFMDSSDNVDVLEDIVLSLTLFEDREMIKQRLLKYEDIFSKKVIANLTRRHYTGWGRLSAKLINGIKDKHSRKTILDYLIDDGHSNRNFMQLINDDNLSFKDEIANSQVIGDGDDLHQVVQELAGSPAIKKGILQSLKIVDELVKVMGYNPEQIVVEMARENQTTARGRNNSQQRLGSLTKAIQDFGSDILKRYPVENNQLQNDQLYLYYLQNGKDMYTGDTLDIHNLSQYDIDHIIPQSFIKDNSLDNRVLTNSKSNRGKSDNVPSNEVVKRMKGFWLKQLDAKLISQRKFDNLTKAERGGLSAEDKAGFIKRQLVETRQITKHVARILDERFNRDFDKNDKRIRNVKIVTLKSNLVSNFRKEFGFYKVREINNFHHAHDAYLNAVVAKALLIRYPKLEPEFVYGEYPKYNSYRERKATEKMFFYSNIMNMFKTTIKLADGRVVEKPVIEANEETGEIAWDKTKHFANVKKVLSYPQVSIVKKVEEQTGGFSKESILPKGGSDKLIARKTKNNYLSTQKYGGFDSPTVAYSIMFVADIEKGKSKRLKTVKEMIGITIMERSRFESNSVTFLEEKGYRNIRENTIIKFPKYSLFELENGRRRLLASAIELQKGNEMFLPQQFVNLLYHAQHANKEDSVIYLEKHRHELSELFHHIIGVSEKTILKPKVEMTLNEAFEKHFEFDEVSELAQSFISLLKFTAFGAPGGFKFLDADIKQSNLRYQTVTEVLSSTLIHQSVTGLYETRIDLSKLGGE

SEQ ID NO: 184 - protein, 1364 aa, Streptococcus sp. M334
SNKSYSIGLDIGTNSVGWAVITDDYKVPSKKMKVLGNTDKHFIKKNLIGALLFDEGTTAEDRRLKRTARRRYTRRKNRLRYLQEIFSQEISKVDSSFFHRLDDFFLVPEDKRGSKYPIFATLVEEKEYHKKFPTIYHLRKHLADSKEKTDLRLIYLALAHMIKYRGHFLYEESFDIKNNDIQKIFSEFISIYDNTFEGKSLSGQNAQVEAIFTDKISKSTKRERVLKLFPDEKSTGLFSEFLKLIVGNQADFKKHFDLEEKAPLQFSKDTYDEDLENLLGQIGDDFADLFLVAKKLYDAILLSGILTVKDLSTKAPLSASMIERYENHQKDLAALKQFIQNNLQEKYDEVFSDQSKDGYAGYIDGKTTQEAFYKYIKNLLSKFEGADYFLDKIEREDFLKKQRTFDNGSIPHQIHLQEMNAIIRRQGEHYPFLQENKEKIEKILTFRIPYYVGPLARGNGDFAWLTRNSDQAIRPWNFEEIVDQASSAEDFINKMTNYDLYLPEEKVLPKHSLLYETFAVYNELTKVKFIAEGLTRYQFLDKKQKKDIFDTFFKAENKRKVTEKDIIHYLHNVDGYDGIELKGIEKQFNASLSTYHDLLKIIKDKAFMDDSKNEEILENIIHTLTIFEDREMIKQRLAQYDSLFDEKVIKALTRRHYTGWGKLSAKLINGIRDKKSGKTILDYLIDDGEINRNFMQLIHDDGLSFKEIIQKAQVFGKTNDVKQVVQELPGSPAIKKGILQSIKIVDELVKVMGHAPESIVIEMARENQTTARGKKNSQQRYKRIEDSLKNLASNILKENPTDNIQLQNDRLFLYYLQNGRDMYTGKPLEINQLSNYDIDHIIPQAFIKDDSLDNRVLTSSKDNRGKSDNVPSLEVVEKMKAFWQQLLDSKLISERKFNNLTKAERERGGLNELDKVGFIKRQLVETRQITKHVAQFLDARFNKEVTEKDKKNRNVKIITLKSNLVSNFRKEFGLYKVREINDYHHAHDAYLNAVLAKAILKKYPKLEPEFVYGDYQKYDLSREPKEVEKATQKYFFYSNLLNFFKEEVHYADGTIVKRENIEYSKDTGEIAWNKEKDFATVKKVLSLPQVNIVKKTEVQTGGFSKESILPKGNSDKLIPRKTKEILWDTTKYGGFDSPVIAYSILLIADIEKGKAKKLKTVKTLVGITIMEKATFEKNPITFLENKGYHNVRKENILCLPKYSLFELESGRRRMLASAKELQKGNEIVLPVYLTTLLYHSKNVHKLDEPEHLEYIQKHRYEFKDLLNLVSEFSQKYVLADANLEKIKNLYADNEQADIEILANSFINLLTFTALGAPAAFKFLGKDVDRKRYTTVSEILNATLIHQSITGLYETRIDLSKLGED

SEQ ID NO: 185 - protein, 1360 aa, Streptococcus sp. taxon 056
NNNNYSIGLDIGTNSVGWAVITDDYKVPSKKMRVLGNTDKRFIKKNLIGALLFDEGTTAEDRRLKRTARRRYTRRKNRLRYLQEIFAEEMSKVDSSFFHRLDDSFLVPEDKSGSKYPIFATLAEEKEYHKKFPTIYHLRKHLADSKEKADLRLIYLALAHITKYRGHFLYEEAFDIKNNDIQKIFNEFINIYDNTFEGSSLSGQNAQVEAIFTGKISKSVKREHVLKLFPDEKSTGLFSEFLKLIVGNQADFKKHFDLEEKASLQFSKDTYDEDLENLLGQIGDDFADLFLVAKKLYDAILLSGILTVTDPSTKAPLSASMIERYENHQEDLAALKQFIKNNLPEKYAEVFSDQSKDGYAGYIDGKTTQEAFYKYIKNLLSKFEGADYFLDKIEREDFLRKQRTFDNGSIPHQIHLQEMNAILRRQGEHYPLLKENKEKIEKILTFRIPYYVGPLARGNRDFAWLTRNSDQAIRPWNFEEIVDKASSAESFINKMTNYDLYLPEEKVLPKHSLLYETFAVYNELTKVKFIAEGLRDYQFFDSGQKKQIVNQLFKEKRKVTEKDIIHYLHNVDGYDGIELKGIEKQFNASLSTYHDLLKIIKDKEFMDNHKNQEILENIVHTLTIFEDREMIKQRLAQYDSIFDEKVIKALTRRHYTGWGKLSAKLINGICDKKTGKTILDYLIDDGYNNRNFMQLINDDGLSFKEIIQKAQVVGKTDDLTQVVRELSGSPAIKKGILQSIKIVDELVKIMGYAPESIVIEMARENQTTAKGKKNSQQRYKRIEDALKNLAPTISKENPTDNIQLQNDRLFLYYLQNGKDMYTGEALDINQLSSYDIDHIIPQAFIKDDSLDNRVLTSSKDNRGKSDNVPSLEVVKKRKAFWQQLLDSKLISERKFNNLTKAERGGLDERDKVGFIKRQLVETRQITKHVARILDARFNTEVSEKNQKIRSVKIITLKSNLVSNFRKEFKLYKVREINDYHHAHDAYLNAVVAKAILKKYPKLEPEFVYGDYQKYDLSKDPKEVEKATEKYFFYSNLLNFFKEEVHYADGTIVKRENIEYSKDTGEIAWNKEKDFVTIKKVLSYPQVNIVKKREVQTGGFSKESILPKGNSDKLIPRKTKDILWDTTKYGGFDSPVIAYSILLIADIEKGKAKKLKTVKTLVGITIMEKAAFEKNPITFLENKGYHNVRKENILCLPKYSLFELENGRRRLLASAKELQKGNEIVLPVYLTTLLYHSKNVHKLDEPEHLEYIQKHRYEFKDLLNLVSEFSQKYVLAEANLEKIKSLYVDNEQADIEILANSFINLLTFTALGAPAAFKFFGKDVDRKRYTTVSEILNATLIHQSITGLYETRIDLSKLGED

SEQ ID NO: 186 - protein, 1359 aa, Streptococcus suis
MKKKYAIGIDIGTNSVGWSVVTDDYKVPSKKMKVFGNTEKRYIKKNLLGTLLFDEGNTAENRRLKRTARRRYTRRRNRILYLQEIFAEEINKIDDSFFQRLDDSFLIVEDKQGSKHPIFGTLQEEKKYHKQFPTIYHLRKQLADSSQKADIRLIYLALAHIIKYRGHFLFEGDLKSENKDVQHLFNDFVEMFDKTVEGSYLSENLPNVADVLVEKVSKSRRLENILHYFPNEKKNGLFGNFLALALGLQPNFKTNFELAEDAKIQFSKETYEEDLEELLGKIGDDYADLFIATKSLYDGILLAGILSTTDSTTKAPLSSSMVNRYEEHKKDLALLKNFIHQNLSDSYKEVFNDKLKDGYAGYIEGKTTQENFYRFIKKAIEKIEGSDYFIDKIDREDFLRKQRTFDNGSIPHQIHLQEMHAIIRRQAEFYPFLVENQDKIEKILTFRIPYYVGPLARGKSEFAWLNRKSDEKIRPWNFDEMVDKETSAENFITRMTNYDQYLPDQKVLPKHSLLYEKFAVYNELTKVKFIAEGMRDYQFLDSGQKKDIVKTLFKTKRKVTAKDIKAYLENSNGYAGVELKGLEEQFNASLPTYHDLLKILRDKAFIDAEENQEILEDIVLTLTLFEDREMIRKRLEKYKDILTEEQRKKLERRHYTGWGRLSAKLINGILDKVTRKTILGYLIDDGTSNRNFMQLINDDTLSFVDEIRLAQGSGEAEDYRAEVQNLAGSPAIKKGILQSLKIVDELIEVMGYDPEHIVVEMARENQFTNQGRRNSQQRYKKIENAIKNLNSKILKEYPTNNQALQNDRLFLYYLQNGKDMYTDEELDIDQLSQYDIDHIIPQAFIKDDSLDNKVLTKSAKNRGKSDDVPSLEIVHKKKNFWKQLLDSQLISQRKFDNLTKAERGGLTNEDKARFIQRQLVETRQITKHVARILDTRFNTKLDEAGNRIRDPKVNIITLKSNLVSQFRKDYQLYKVREINNYHHAHDAYLNAVVATALLKKYPQLAPEFVYGDYPKYNSYKSRKATEKVLFYSNIMNFFRRVLVYSKTGEVRIRPVIEVNKETGEIVWDKKSDFRTVRKVLSYPQVNVVKKVEMQTGGFSKESILQHGDSDKLIPRKTEKFYLDTKKYGGFDSPTIAYSVLLIADIEKGKAKKLKRVKELIGITIMERMAFEKNPIEFLEHKGYKNILEKNIIKLPKYSLFELENGRRRLLASAKELQKGNEMILPPHLVTLLYHSSNIHKITEPIHLNYVNKNKHEFKELLRHISDFSTRYILAQDRLSKIEELYDKNDGDDISDLTSSFVNLLTFTAIGAPAAFKFLGSVIDRKRYTSIAEILEATLIHQSVTGLYETRIDLSKLGGD

SEQ ID NO: 187 - protein, 1361 aa, Streptococcus suis
MKKKYAIGIDIGTNSVGWSVVTDDYKVPSKKMKVFGNTEKRYIKKNLLGTLLFDEGNTAENRRLKRTARRRYTRRRNRILYLQEIFAEEINKIDDSFFQRLDDSFLIVEDKQGSKHPIFGTLQEEKEYHKQFPTIYHLRKQLADSSQKADIRLIYLALAHIIKYRGHFLFEGDLKSENKDVQHLFNDFVEMFDKTVEGSYLSENLPNVADVLVEKVSKSRRLENILHYFPNEKKNGLFGNFLTLALGLQPNFKTNFELAEDAKIQFSKETYEEDLEELLGKIGDDYADLFIATKSLYDGILLAGILSTTDSTTKAPLSSSMVNRYEEHQKDLALLKNFIHQNLSDSYKEVFNDKLKDGYAGYIEGKTTQENFYRFIKKAIEKIEGSNYFIDKIDREDFLRKQRTFDNGSIPHQIHLQEMHAIIRRQAEFYPFLVENQDKIEKILTFRIPYYVGPLARGKSEFAWLNRKSDEKIRPWNFDEMVDKETSAENFITRMTNYDQYLPDQKVLPKHSLLYEKFAVYNELTKVRYVTEQGKSFFFDANMKQEIFDGVFKVYRKVTKEKLMDFLGKEFDEFRIVDLLGLDKDNKSFNASLGTYHDLKKIVSKDLLDNPENEDILENVVLTLTLFEDREMIRKRLEKYKDVLTEEQRKKLERRHYTGWGRLSAKLINGIRDKVTRKTILDYLIDDGTSNRNFMQLINDDTLSFVDEIRLAQGSGEAEDYRAEVQNLAGSPAIKKGILQSLKIVDELIEVMGYDPEHIVVEMARENQFTNQGRRNSQQRYKKIENAIKNLNSKILKEYPTNNQALQNDRLFLYYLQNGKDMYTDEELDIDQLSQYDIDHIIPQAFIKDDSLDNKVLTKSAKNRGKSDDVPSLEIVHKKKNFWKQLLDSQLISQRKFDNLTKAERGGLTNEDKARFIQRQLVETRQITKHVARILDTRFNTKLDEAGNRIRDPKVNIITLKSNLVSQFRKDYQLYKVREINNYHHAHDAYLNAVVATALLKKYPQLAPEFVYGDYPKYNSYKSRKATEKVLFYSNIMNFFRRVLVYSKTGEVRIRPVIEVNKETGEIVWDKKSDFRTVRKVLSYPQVNVVKKVEMQTGGFSKESILQHGDSDKLIPRKTEKFYLDTKKYGGFDSPTIAYSVLLIADIEKGKAKKLKRVKELIGITIMERMAFEKNPIEFLEHKGYKNILEKNIIKLPKYSLFELENGRRRLLASAKELQKGNEMILPPHLVTLLYHSSNIHKITEPIHLNYVNKNKHEFKELLRHISDFSTRYILAQDRLSKIEELYDKNDGDDISDLTSSFVNLLTFTAIGAPAAFKFLGSVIDRKRYTSIAEILEATLIHQSVTGLYETRIDLSKLGGD

SEQ ID NO: 188 - protein, 1361 aa, Streptococcus suis
MKKKYAIGIDIGTNSVGWSVVTDDYKVPSKKMKVFGNTEKRYIKKNLLGTLLFDEGNTAENRRLKRTARRRYTRRRNRILYLQEIFAEEINKIDDSFFQRLDDSFLIVEDKQGSKHPIFGTLQEEKEYHKQFPTIYHLRKQLADSSQKADIRLIYLALAHIIKYRGHFLFEGDLKSENKDVQHLFNDFVEMFDKTVEGSYLSENLPNVADVLVEKVSKSRRLENILHYFPNEKKNGLFGNFLALALGLQPNFKTNFELAEDAKIQFSKETYEEDLEELLGKIGDDYADLFIATKSLYDGILLAGILSTTDSTTKAPLSSSMVNRYEEHQKDLALLKNFIHQNLSDSYKEVFNDKLKDGYAGYIEGKTTQENFYRFIKKAIEKIEGSNYFIDKIDREDFLRKQRTFDNGSIPHQIHLQEMHAIIRRQAEFYPFLVENQDKIEKILTFRIPYYVGPLARGKSEFAWLNRKSDEKIRPWNFDEMVDKETSAENFITRMTNYDQYLPDQKVLPKHSLLYEKFAVYNELTKVRYVTEQGKSFFFDANMKQEIFDGVFKVYRKVTKEKLMDFLGKEFDEFRIVDLLGLDKDNKSFNASLGTYHDLKKIVSKDLLDNPENEDILENVVLTLTLFEDREMIRKRLEKYKDVLTEEQRKKLERRHYTGWGRLSAKLINGIRDKVTRKTILDYLIDDGTSNRNFMQLINDDTLSFVDEIRLAQGSGEAEDYRAEVQNLAGSPAIKKGILQSLKIVDELIEVMGYDPEHIVVEMARENQFTNQGRRNSQQRYKKIENAIKNLNSKILKEYPTNNQALQNDRLFLYYLQNGKDMYTDEELDIDQLSQYDIDHIIPQAFIKDDSLDNKVLTKSAKNRGKSDDVPSLEIVHKKKNFWKQLLDSQLISQRKFDNLTKAERGGLTNEDKARFIQRQLVETRQITKHVARILDTRFNTKLDEAGNRIRDPKVNIITLKSNLVSQFRKDYQLYKVREINNYHHAHDAYLNAVVATALLKKYPQLAPEFVYGDYPKYNSYKSRKATEKVLFYSNIMNFFRRVLVYSKTGEVRIRPVIEVNKETGEIVWDKKSDFRTVRKVLSYPQVNVVKKVEMQTGGFSKESILQHGDSDKLIPRKTEKFYLDTKKYGGFDSPTIAYSVLLIADIEKGKAKKLKRVKELIGITIMERMAFEKNPIEFLEHKGYKNILEKNIIKLPKYSLFELENGRRRLLASAKELQKGNEMILPPHLVTLLYHSSNIHKITEPIHLNYVNKNKHEFKELLRHISDFSTRYILAQDRLSKIEELYDKNDGDDISDLTSSFVNLLTFTAIGAPAAFKFLGSVIDRKRYTSIAEILEATLIHQSVTGLYETRIDLSKLGGD

SEQ ID NO: 189 - protein, 1359 aa, Streptococcus suis
MKKKYAIGIDIGTNSVGWSVVTDDYKVPSKKMKVFGNTEKRYIKKNLLGTLLFDEGNTAENRRLKRTARRRYTRRRNRILYLQEIFAEEINKIDDSFFQRLDDSFLIVEDKQGSKHPIFGTLQEEKKYHKQFPTIYHLRKQLADSSQKADIRLIYLALAHIIKYRGHFLFEGDLKSENKDVQHLFNDFVEMFDKTVEGSYLSENLPNVADVLVEKVSKSRRLENILHYFPNEKKNGLFGNFLALALGLQPNFKTNFELAEDAKIQFSKETYEEDLEELLGKIGDDYADLFIATKSLYDGILLAGILSTTDSTTKAPLSSSMVNRYEEHKKDLALLKNFIHQNLSDSYKEVFNDKLKDGYAGYIEGKTTQENFYRFIKKAIEKIEGSDYFIDKIDREDFLRKQRTFDNGSIPHQIHLQEMHAIIRRQAEFYPFLVENQDKIEKILTFRIPYYVGPLARGKSEFAWLNRKSDEKIRPWNFDEMVDKETSAENFITRMTNYDQYLPDQKVLPKHSLLYEKFAVYNELTKVKFIAEGMRDYQFLDSGQKKDIVKTLFKTKRKVTAKDIKAYLENSNGYAGVELKGLEEQFNASLPTYHDLLKILRDKAFIDAEENQEILEDIVLTLTLFEDREMIRKRLEKYKDILTEEQRKKLERRHYTGWGRLSAKLINGILDKVTRKTILGYLIDDGTSNRNFMQLINDDTLSFVDEIRLAQGSGEAEDYRAEVQNLAGSPAIKKGILQSLKIVDELIEVMGYDPEHIVVEMARENQFTNQGRRNSQQRYKKIENAIKNLNSKILKEYPTNNQALQNDRLFLYYLQNGKDMYTDEELDIDQLSQYDIDHIIPQAFIKDDSLDNKVLTKSAKNRGKSDDVPSLEIVHKKKNFWKQLLDSQLISQRKFDNLTKAERGGLTNEDKARFIQRQLVETRQITKHVARILDTRFNTKLDEAGNRIRDPKVNIITLKSNLVSQFRKDYQLYKVREINNYHHAHDAYLNAVVATALLKKYPQLAPEFVYGDYPKYNSYKSRKATEKVLFYSNIMNFFRRVLVYSKTGEVRIRPVIEVNKETGEIVWDKKSDFKTVRKVLSYPQVNVVKKVEMQTGGFSKESILQHGDSDKLIPRKTEKFYLDTKKYGGFDSPTIAYSVLLIADIEKGKAKKLKRVKELIGITIMERMAFEKNPIEFLEHKGYKNILEKNIIKLPKYSLFELENGRRRLLASAKELQKGNEMILPPHLVTLLYHSSNIHKITEPIHLNYVNKNKHEFKELLRHISDFSTRYILAQDRLSKIEELYDKNDGDDISDLTSSFVNLLTFTAIGAPAAFKFLGSVIDRKRYTSIAEILEATLIHQSVTGLYETRIDLSKLGGD

SEQ ID NO: 190 - protein, 1351 aa, Streptococcus suis
MDQKYSIGLDIGTNSVGWAVVTDDYKVPAKKMKVLGNTDKQSIKKNLLGALLFDSGETAEATRLKRTARRRYTRRRNRLRYLQEIFAEEMNKVDENFFQRLDDSFLVDEDKRGERHPIFGNIAAEVKYHDDFPTIYHLRKHLADISQKADLRLVYLALAHMIKFRGHFLIEGQLKAENTNVQALFKDFVEVYDKTVEESHLSEMTVDALSILTEKVSKSRRLENLIAHYPAEKKNTLFGNLIALSLGLQPNFKTNFQLSEDAKLQFSKDTYEEDLEGLLGEIGDEYADLFASAKNLYDAILLSGILTVDDNSTKAPLSASMVKRYEEHQKDLKKLKDFIKVNAPDQYNAIFKDKNKKGYAGYIENGVKQDEFYKYLKGILLQINGSGDFLDKIDREDFLRKQRTFDNGSIPHQIHLQEMHAILRRQEEHYPFLKENQDKIEKILTFRIPYYVGPLARKGSRFAWAEYKADEKITPWNFDDILDKEKSAEKFITRMTLNDLYLPEEKVLPKHSLLYETFTVYNELTKVKYVNEQGEAKFFDANMKQEIFDHVFKENRKVTKDKLLNYLGKEFDEFRIVDLTGLDKENKVFNSSLGTYHDLRKILDKSFLDNKENEQIIEDIIQTLTLFEDREMIRQRLQKYSDIFTKAQLKKLERCHYTGWGRLSYKLINGIRNKENKKTILDYLIDDGYANRNFMQLINDDALSFKEEIAKAQVIGETDDLNQVVSDIAGSPAIKKGILQSLKIVDELVKVMGYNPANIVIEMARENQTTDKGRRNSQQRLKLLQDSLKPVNIKNVENQQLQNDRLFLYYIQNGKDMYTGETLDINNLSQYDIDHIIPQAFIKDDSFDNRVLTSSSENRGKSDNVPSIEVVRARKADWMRLRKAGLISQRKFDNLTKAERGGLTENDKAGFIKRQLVETRQITKHVAQVLDARFNAKHDENKKVIRDVKIITLKSNLVSQFRKDFKFYKVREINDYHHAHDAYLNAVIGTALLKKYPKLASEFVYGEFKKYDVSDKEIGKATAKYFFYSNLMNFFKKEVKFADGTVVERPDIETSEDGEIAWNKQTDFKIVRKVLSYPQVNIVKKTEVQTHGLDRPSPKPKPDSSENLVGVKRNLDPKKYGGYAGISNSYAVLVKAIIEKGVKKKETMVLEFQGISILDRITFEKDKRAFLLGKGYKDIKKIIELPKYSLFELKDGSRRMLASRGEIHKGNELFVPQKFTTLLYHAKRINNPINKDHIEYVKKHRDDFKELLNYVLEFNEKYVGATKNGERLKEAVADFDSKSNEEICTSFLGLFELTSLGSASDFEFLGVKIPRYRDYTPSSLLKDSTLIHQSITGLYETRIDLSKLGED

SEQ ID NO: 191 - protein, 1256 aa, Brochothrix thermosphacta
MWGVSLFEAGKTAAERRGYRSTRRRLNHRKFRLRLLEDMFEKEILSKDPSFFIRLKEAFLSPKDEQKQFLFNDKDYTDADYYEQYKTIYHLRYDLISQHRQFDIREVYLAIHHLIKYRGHFIYEDQTFTTDGNQLQHHIKAIITMINSTLNRIIPETIDINVFEKILLDRMMNRSSKVKFLIELTGKQDKPLLKELFNLIVGLKAKPASIFEQENLATIVETMNMSTEQVQLDLLTLADVLADEEYDLLLTAQKIYSAIILDESMDGYEYFAEAKKESYRKHQEELVLVKKMLKSNAITNDERAKFEYFYTDYIGYEESKSKEERLFKHIELLLAKENVLTTVEHALLEKNITFASLLPLQRSSRNAVIPYQVHEKELVAILENQATYYPFLLEQKDNIHKLLTFRIPYYVGPLADQKDSEFAWMVRKQAGKITPFNFEEMVDIDASSEAFIKRMTNKCTYLIHEDVIPKHSFSYAKFEVLNELNKIRLDGKPIDIPLKKRIFEGLFLEKTKVTQTSLKKWLAEHEHMTVSVVQGTQKETEFATSLQAFHRFVKIFDRETVSNPANEEMFEKIIYWSTVFEDKKIMRRKLSEYPQLTEQQQVQLAQVRFRGWGRLSQRLINRIKTPEDHKLSINEILQTNENFMQIIRNKDYLFKKIIEEQFENETALLNKQRIDELAASPANKKGIWQAIKIVKELEKVLQQPAENIFIEFARSDEESKRSTPRDKFIEKAYAETDTEHLKELKQRSKQLSSQRLFLYFIQNGKCMYSGEHLDIERLDSYEVDHILPQSYIKDNSIENLALVKKVENQRKKDSLLLNSSIINQNYSRWEQLKNAGLIGEKKFRNLTRTKITDRDKEGFIARQLVETRQITKHVTQLLQQEYKDTTKVFAIKATLVSGLRRKFEFIKNRNVNDYHHAQDAFLVAFLGTNITSNYPKIEMEYLFKGYQHYLNEVGKAAKPKFTFIVENLSKQQNSTTGEVKWNPEVDIAKLKRILNFKQCNIVRKVEEQSGALFKETIYPVEESSSKTIPLKKHLDTAIYGGYTAVNYASYALIQFKKGRKLKREIIGIPLAVQTRIDNSETSLQAYIAEQIKSEVEILNGRILKYQLISNNGNRLYIAGSERHNARQLIVSDEAAKVIWLISTKQADEAMFLKYYRLEHLEAVFEELIRKQAADYQIFEKLIKKIEVNFYSCTYNEKVKVIELLKITQANATNGDLKLLKMSNREGRLGSVSVALDFKIINQSVTGLYQSIEDYNN

SEQ ID NO: 192 - protein, 1290 aa, Catenibacterium mitsuokai
IVDYCIGLDLGTGSVGWAVVDMNHRLMKRNGKHLWGSRLFSNAETAANRRASRSIRRRYNKRRERIRLLRAILQDMVLEKDPTFFIRLEHTSFLDEEDKAKYLGDNYNLFIDEDFNDYTYYHKYPTIYHLRKALCESTEKADPRLIYLALHHIVKYRGNFLYEGQKFNMDASNIEDKLSDIFTQFTSFNNIPYEDDKKNLEILEILKKPLSKKAKVDEVMTLIAPEKDYKSAFKELVTGIAGNKMNVTKMILCEPIKQGDSEIKLKFSDSNYDDQFSEVEKDLGEYVEFVDALHNVYSWVELQTIMGATHTDNASISEAMVSRYNKHHDDLKLLKDCIKNNVPNKYFDMFRNDSEKSKGYYNYINRKAPVDEFYKYVKKCIEKVDTPEAKQILNDIELENFLLKQNSRTNGSVPYQMQLDEMIKIIDNQAEYYPILKEKREQLLSILTFRIPYYFGPLETSEHAWIKRLEGKENQRILPWNYQDIVDVDATAEGFIKRMRSYCTYFPDEEVLPKNSLIVSKYEVYNELNKIRVDDKLLEVDVKNDIYNELFMKNKTVTEKKLKNWLVNNQCCSKDAEIKGFQKENQFSTSLTPWIDFTNIFGKIDQSNFDLIENIIYDLTVFEDKKIMKRRLKKKYALPDDKVKQILKLKYKDWSRLSKKLLDGIVADSVTVLDVLESRLNLMEIINDKDLGYAQMIEEATSCPEDGKFTYEEVERLAGSPALKRGIWQSLQIVEEITKVMKCRPKYIYIEFERSEEKERTESKIKKLENVYKDEQTSVLEELKGFDNTKKISSDSLFLYFTQLGKCMYSGKKLDIDSLDKYQIDHIVPQSLVKDDSFDNRVLVVPSENQRKLDDLVVPFDIRDKMYRFWKLLFDHELISPKKFYSLIKTEYTERDEERFINRQLVETRQITKNVTQIIEDHYSTTKVAAIRANLSHEFRVKNHIYKNRDINDYHHAHDAYIVALIGGFMRDRYPNMHDSKAVYSEYMKMFRNKNDQKGFVINSMNYPYEVDGKLIWNPDLINEIKKCFYYKDCYCTTKLDQKSGQLFNTVLSNDAHADKGAVVPVNKNRSDVHKYGGFSGLQYTIVAIEGQKKKGKKTELVKKISGVPLHLKAASINEKINYIEEKEGLSDVRIIKDNIPVNQMIEMDGGEYLLTSEYVNARQLVLNEKQCALIADIYNAIYKQDYDNLDDILMIQLYIELTNKMKVLYPAYRGIAEKFESYVVISKEEKANIIQMLIVMHRGPQNGNIVYDDFKISDRIGRLKTKNHNLNIVFISQSPTGIYTKKYKL

SEQ ID NO: 193 - protein, 1359 aa, Artificial Sequence; identical to SEQ ID NO: 11
  Synthetic Polypeptide

SEQ ID NO: 194 - protein, 1317 aa, Clostridiales bacterium S5-A11
MKNYTIGLDIGTNSVGWAVIKDDLTLVRKKIKISGNTDKKEVKKNLWGSFLFEQGDTAQDTRVKRIARRRYERRRFRIRELQKIFDKSMGEVDSNFFHRLDESFLVEEDKEYSKYPIFSNEKEDKNYYDKYPTIYHLRKDLADSNQKADLRLIYLALAHMIKYRGHFLIEGDLKMDGISISESFQEFIDSYNEVCALEDENNDELLTQIENIFKQDISRSKKLDQAIALFQGKRQSLFGIFLTLIVGNKANFQKIFNLEDDIKLDLKEEDYDENLEELLSNIDEGYRDVFLQAKNVYNAIELSKILKTDGKETKAPLSAQMVELYNQHREDLKKYKDYIKAYLPEKYGETFKDATKNGYAGYIDGKTSQEDFYKFVKAQLKGEENGEYFLEAIENENFLRKQRSFYNGVIPYQIHLQELTAVLDQQEKHYSFLKENRDKIISLLTFRIPYYVGPLAKGESRFAWLERSNSEEKIKPWNFDKIVDIDKSAELFIENLTSRDTYLPDEPVLPKRSLIYQKFTIFNELTKISYIDERGILQNFSSREKIAIFNDLFKNKSKVTKNQLVKYIENKEQIIAPEIKGIEDSFNSNYSTYIDLSKIPDMKLLEKDEDEILEEIIKILTIFEDRKMRKRQLMKFKDKLSEKAINQLSKKHYTGWGQLSEKLINGIRDEQSNKTILDYLIDNGCPKNMNRNFMQLINDDTLSFKEKIRKAQDINQVNDIKEIVKDLPGSPAIKKGIYQSIRIVDEIIRKMKDRPKNIVIEMARENQTTQEGKNKSKARLKKIQEGLENLDSHVEKQALDEEMLKSPKYYLYCLQNGKDIYTGKDLDIGQLQTYDIDHIIPRSFITDNSFDNLVLTSSTVNRGKLDNVPSPDIVRQQKGFWKQLLRAGLMSQRKFNNLTKGKLTDRDRQQFINRQLVETRQITKHVANLLSHHLNEKKEVGEINIVLLKSALTSQFRKKFDFYKVREVNDYHHAHDAYLNGVIALKLLELYPYMAKDLIYGKYSYHRKGDKATQAKYKMSNIIERFSQDLLANPDGEIAWEKDKDLNTIRKVLSSKQINIIKKAEEGKGRLFKETINSRPSKKTEKRIPIKNNLDPNIYGGYIEEKMAYYIAINYLENGKTKKAIVGISIKDKKDFEGQTTEYLGKIGFNKASIINSFKNYTLFELENGSRRMIVGKGELQKGNQMYLPQNLLEFVYHLKHYNEDETSHKFIVEHKAYFDELLNYIVEFANKYLELENSIEKIKDLYHGKGPDVEEKELVESFINLLAITKCGPAADITFLGEKISRKRYRSTNCLWGSEVIFQSPTGLYETRLRLE

SEQ ID NO: 195 - protein, 1359 aa, Artificial Sequence; identical to SEQ ID NO: 11
  Synthetic Polypeptide

SEQ ID NO: 196 - protein, 1327 aa, Dolosigranulum pigrum
MQKNYTIGLDIGTNSVGWAVMKDDYTLIRKRMKVLGNTDIKKIKKNFWGVRLFDEGETAKETRLKRGTRRRYQRRRNRLIYLQDIFQQPMLAIDENFFHRLDDSFFVPDDKSYDRHPIFGSLEEEVAYHNTYPTIYHLRKHLADNPEKADLRLVYTALAHIVKYRGHFLIEGELNTENTSISETFEQFLDTYSDIFKEQLVGDISKVEEILSSKQSRSRKHEQIMALFPNENKLGNFGRFMMLIVGNTSNFKPVFDLDDEYKLKLSDETYEEDLDTLLGMTDDVFLDVFMAAKNVYDAVEMSAIISTDTGNSKAVLSNQMINFYDEHKVDLAQLKQFFKTHLPDKYYECFSDPSKNGYAGYIDGKTNQEDFYKYIEKVMKTIKSDKKDYFLDKIDREVFLRKQRSFYNSVIPHQIHLQEMQAILDRQSQYYPFLAENRDKIESLVTFRIPYYVGPLTVSDQSEFAWMERQSDEPIRPWNFDEIVNKERSAEKFIERMTNMDTYLLEEKVLPKRSLLYQTFEVYNELTKVRYTNEQGKTEKLNRQQKAEIIETLFKQKNRVREKDIANYLEQYGYVDGTDIKGVEDKFNASLSTYNDLAKIDGAKAYLDDPEYADVWEDIIKILTIFEDKAMRKKQLQTYSDTLSPEILKKLERKHYTGWGRFSKKLINGLRDEGSNKTILDYLKDEGSSGPTNRNFMQLIRDNTLSFKKKIEDAQTIEDTTHIYDTVAELPGSPAIKKGIRQALKIVEEIIDIIGYEPENIVVEMARESQTTKKGKDLSKERLEKLTEAIKEFDGVKVKDLKNENLRNDRLYLYYLQNGRDMYTNEPLDINNLSKYDIDHIIPQSFTTDNSIDNKVLVSRTKNQGNKSDDVPSINIVHKMKPFWRQLHKAGLISDRKFKNLTKAEHGGLTEADRAHFLNRQLVETRQITKHVANLLDSQYNTAEEQRINIVLLKSSMTSRFRKEFKLYKVREINDYHHGHDAYLNAVVATTIMKVYPNLKPQFVYGQYKKTSMFKEEKATARKHFYSNITKFFKKEKVVNEETGEILWDTERHLSTIKRVLSWKQMNIVKKVEKQKGQLWKETIYPKGDSSKLIPVKEGMDPQKYGGLSQVSEAFAVVITHEKGKKKQLKSDLISIPIVDQKAYEQHPTAYLEEAGYNNPTVLHELFKYQLFELEDGSRRMIASAKEFQKGNQMVLPLELVELLYHANRYDKVKFPDSIEYVHDNLAKFDDLLEYVIDFSNKYINADKNVQKIQKIYKEHGTEDVELTVESFVNLMTFTAMGAPATFKFYGESITRSRYTSITEFRGSTLIFQSITGLYETRYKLED

SEQ ID NO: 197 - protein, 1329 aa, Artificial Sequence
  Synthetic Polypeptide
MKKDYVIGLDIGTNSVGWAVMTEDYQLVKKKMPIYGNTEKKKIKKNFWGVRLFEEGHTAEDRRLKRTARRRISRRRNRLRYLQAFFEEAMTDLDENFFARLQESFLVPEDKKWHRHPIFAKLEDEVAYHETYPTIYHLRKKLADSSEQADLRLIYLALAHIVKYRGHFLIEGKLSTENISVKEQFQQFMIIYNQTFVNGESPLPESVLIEEELTEKASRTKKSEKVLQQFPQEKANGLFGQFLKLMVGNKADFKKVFGLEEEAKITYASESYEEDLEGILAKVGDEYSDVFLAAKNVYDAVELSTILADSDKKSHAKLSSSMIVRFTEHQEDLKKFKRFIRENCPDEYDNLFKNEQKDGYAGYIAHAVSQLKFYQYVKKIIQDIAGAEYFLEKIAQENFLRKQRTFDNGVIPHQIHLAELQAIIHRQAAYYPFLKENQEKIEQLVTFRIPYYVGPLSKGDASTFAWLKRQSEEPIRPWNLQETVDLDQSATAFIERMTNFDTYLPSEKVLPKHSLLYEKFMVFNELTKISYTDDRGIKANFSGKEKEKIFDYLFKTRRKVKKKDIIQFYRNEYNTEIVTLSGLEEDQFNASFSTYQDLLKCGLTRAELDHPDNAEKLEDIIKILTIFEDRQRIRTQLSTFKGQFSAEVLKKLERKHYTGWGRLSKKLINGIYDKESGKTILGYLIDDGVSKHYNRNFMQLINDSQLSFKNAIQKAQSSEHEETLSETVNELAGSPAIKKGIYQSLKIVDELVAIMGYAPKRIVVEMARENQTTSTGKRRSIQRLKIVEKAMAEIGSNLLKEQPTTNEQLRDTRLFLYYMQNGKDMYTGDELSLHRLSHYDIDHIIPQSFMKDDSLDNLVLVGSTENRGKSDDVPSKEVVKDMKAYWEKLYAAGLISQRKFQRLTKGEQGGLTLEDKAHFIQRQLVETRQITKNVAGILDQRYNANSKEKKVQIITLKASLTSQFRSIFGLYKVREVNDYHHGQDAYLNCVVATTLLKVYPNLAPEFVYGEYPKFQTFKENKATAKAIIYTNLLRFFTEDEPRFTKDGEILWSNSYLKTIKKELNYHQMNIVKKVEVQKGGFSKESIKPKGPSNKLIPVKNGLDPQKYGGFDSPIVAYTVLFTHEKGKKPLIKQEILGITIMEKTRFEQNPILFLEEKGFLRPRVLMKLPKYTLYEFPEGRRRLLASAKEAQKGNQMVLPEHLLTLLYHAKQCLLPNQSESLAYVEQHQPEFQEILERVVDFAEVHTLAKSKVQQIVKLFEANQTADVKEIAASFIQLMQFNAMGAPSTFKFFQKDIERARYTSIKEIFDATIIYQSTTGLYETRRKVVD

SEQ ID NO: 198 - protein, 1280 aa, Artificial Sequence
  Synthetic Polypeptide
MRLFEEGHTAEDRRLKRTARRRISRRRNRLRYLQAFFEEAMTDLDENFFARLQESFLVPEDKKWHRHPIFAKLEDEVAYHETYPTIYHLRKKLADSSEQADLRLIYLALAHIVKYRGHFLIEGKLSTENTSVKDQFQQFMVIYNQTFVNGESPLPESVLIEEELTEKASRTKKSEKVLQQFPQEKANGLFGQFLKLMVGNKADFKKVFGLEEEAKITYASESYEEDLEGILAKVGDEYSDVFLAAKNVYDAVELSTILADSDKKSHAKLSSSMIVRFTEHQEDLKKFKRFIRENCPDEYDNLFKNEQKDGYAGYIAHAVSQLKFYQYVKKIIQDIAGAEYFLEKIAQENFLRKQRTFDNGVIPHQIHLAELQAIIHRQAAYYPFLKENQEKIEQLVTFRIPYYVGPLSKGDASTFAWLKRQSEEPIRPWNLQETVDLDQSATAFIERMTNFDTYLPSEKVLPKHSLLYEKFMVFNELTKISYTDDRGIKANFSGKEKEKIFDYLFKTRRKVKKKDIIQFYRNEYNTEIVTLSGLEEDQFNASFSTYQDLLKCGLTRAELDHPDNAEKLEDIIKILTIFEDRQRIRTQLSTFKGQFSAEVLKKLERKHYTGWGRLSKKLINGIYDKESGKTILDYLVDDGVSKHYNRNFMQLINDSQLSFKNAIQKAQSSEHEETLSETVNELAGSPAIKKGIYQSLKIVDELVAIMGYAPKRIVVEMARENQTTSTGKRRSIQRLKIVEKAMAEIGSNLLKEQPTTNEQLRDTRLFLYYMQNGKDMYTGDELSLHRLSHYDIDHIIPQSFMKDDSLDNLVLVGSTENRGKSDDVPSKEVVKDMKAYWEKLYAAGLISQRKFQRLTKGEQGGLTLEDKAHFIQRQLVETRQITKNVAGILDQRYNAKSKEKKVQIITLKASLTSQFRSIFGLYKVREVNDYHHGQDAYLNCVVATTLLKVYPNLAPEFVYGEYPKFQTFKENKATAKAIIYTNLLRFFTEDEPRFTKDGEILWSNSYLKTIKKELNYHQMNIVKKVEVQKGGFSKESIKPKGPSNKLIPVKNGLDPQKYGGFDSPVVAYTVLFTHEKGKKPLIKQEILGITIMEKTRFEQNPILFLEEKGFLRPRVLMKLPKYTLYEFPEGRRRLLASAKEAQKGNQMVLPEHLLTLLYHAKQCLLPNQSESLAYVEQHQPEFQEILERVVDFAEVHTLAKSKVQQIVKLFEANQTADVKEIAASFIQLMQFNAMGAPSTFKFFQKDIERARYTSIKEIFDATIIYQSPTGLYETRRKVVD

SEQ ID NO: 199 - protein, 1072 aa, Enterococcus durans
MDEEAKIQLSKESYEEELESLLEKSGEEFRDVFLQAKKVYDAILLSDILSTKKQNSKAKLSLGMIERYDSHKKDLEELKQFVKANLPEKTAIFFKDSSKNGYAGYIDGKTTQEDFYKFLKKELNGIAGSERFMEKVDQENFLLKQRTTANGVIPHQVHLTELKAIIERQKPYYPSLEEARDKMIRLLTFRIPYYVGPLAQGEETSSFAWLERKTPEKVTPWNATEVIDYSASAMKFIQRMINYDTYLPTEKVLPKHSILYQKYTIFNELTKVAYKDERGIKHQFSSKEKREIFKELFQKQRKVTVKKLQQFLSANYNIEDAEILGVDKAFNSSYATYHDFLDLAKPNELLEQPEMNAMFEDIVKILTIFEDREMIRTQLKKYQSVLGDGFFKKLVKKHYTGWGRLSERLINGIRDKKTNKTILDYLIDDDFPYNRNRNFMQLINDDSLSFKEELANELALAGNQSLLEVVEALLGSPAIKKGIWQTLKIVEELIEIIGYNPKNIVVEMARENQRTNRSKPRLKALEEALKSFDSPLLKEQPVDNQALQKDRLYLYYLQNGKDMYTGEALDIDRLSEYDIDHIIPRSFIVDNSIDNKVLVSSKENRLKMDDVPDQKVVIRMRRYWEKLLRANLISERKFAYLTKLELTPEDKARFIQRQLVETRQITKHVAAILDQYFNQPEESKNKGIRIITLKSSLVSQFRKTFGINKVREINNHHHAHDAYLNGVVAIALLKKYPKLEPEFVYGNYTKFNLATENKATAKKEFYSNILRFFEKEEYSYDENGEIFWDKARHIPQIKKVISSHQVNIVKKVEVQTGGFYKETVNPKGKPDKLIQRKAGWDVSKYGGFGSPVVAYAVAFIYEKGKARKKAKAIEGITIMKQSLFEQDPIGFLSNKGYSNVTKFIKLSKYTLYELENGRRRMVASKEAQKANSFILPEKLVTLLYHAQHYDEIAHKESFDYVNDHLSEFREILDQVIDFSNRYTIAAKNTEKIAELFEQNQESTVQSLSQSFINLMQLNAMGAPADFKFFDVIIPRKRYPSLTEIWESTIIYQSITGLRETRTRMATLWDGEQ

SEQ ID NO: 200 - protein, 1329 aa, Enterococcus faecalis
MKKDYVIGLDIGTNSVGWAVMTEDYQLVKKKMPIYGNTEKKKIKKNFWGVRLFEEGHTAEDRRLKRTARRRISRRRNRLRYLQAFFEEAMTDLDENFFARLQESFLVPEDKKWHRHPIFAKLEDEVAYHETYPTIYHLRKKLADSSEQADLRLIYLALAHIVKYRGHFLIEGKLSTENTSVKEQFQQFMVIYNQTFVNGESPLPESVLIEEELTEKASRTKKSEKVLQQFPQEKANGLFGQFLKLMVGNKADFKKVFGLEEEAKITYASESYEEDLEGILAKVGDEYSDVFLAAKNVYDAVELSTILADSDKKSHAKLSSSMIVRFTEHQEDLKKFKRFIRENCPDEYDNLFKNEQKDGYAGYIAHAVSQLKFYQYVKKIIQDIAGAEYFLEKIAQENFLRKQRTFDNGVIPHQIHLAELQAIIHRQAAYYPFLKENQEKIEQLVTFRIPYYVGPLSKGDASTFAWLKRQSEEPIRPWNLQETVDLDQSATAFIERMTNFDTYLPSEKVLPKHSLLYEKFMVFNELTKISYTDDRGIKANFSGKEKEKIFDYLFKTRRKVKKKDIIQFYRNEYNTEIVTLSGLEEDQFNASFSTYQDLLKCGLTRAELDHPDNAEKLEDIIKILTIFEDRQRIRTQLSTFKGQFSAEVLKKLERKHYTGWGRLSKKLINGIYDKESGKTILDYLVDDGVSKHYNRNFMQLINDSQLSFKNAIQKAQSSEHEETLSETVNELAGSPAIKKGIYQSLKIVDELVAIMGYAPKRIVVEMARENQTTSTGKRRSIQRLKIVEKAMAEIGSNLLKEQPTTNEQLRDTRLFLYYMQNGKDMYTGDELSLHRLSHYDIDHIIPQSFMKDDSLDNLVLVGSTENRGKSDDVPSKKVVKKMKAYWEKLYAAGLISQRKFQRLTKGEQGGLTLEDKAHFIQRQLVETRQITKNVAGILDQRYNAKSKEKKVQIITLKASLTSQFRSIFGLYKVREVNDYHHGQDAYLNCVVATTLLKVYPNLAPEFVYGEYPKFQAFKENKATAKTIIYTNLMRFFTEDEPRFTKDSEILWSNSYLKTIKKELNYHQMNIVKKVEVQKGGFSKESIKPKGPSNKLIPVKNGLDPQKYGGFDSPVVAYTVLFTHEKGKKPLIKQEILGITIMEKTRFEQNPILFLEEKGFLRPRVLMKLPKYTLYEFPEGRRRLLASAKEAQKGNQMVLPEHLLTLLYHAKQCLLPNQSESLAYVEQHQPEFQEILERVVDFAEVHTLAKSKVQQIVKLFEANQTADVKEIAASFIQLMQFNAMGAPSTFKFFQKDIERARYTSIKEIFDATIIYQSTTGLYETRRKVVD

SEQ ID NO: 201 - protein, 1329 aa, Enterococcus faecalis
MKKDYVIGLDIGTNSVGWAVMTEDYQLVKKKMPIYGNTEKKKIKKNFWGVRLFEEGHTAEDRRLKRTARRRISRRRNRLRYLQAFFEEAMTALDENFFARLQESFLVPEDKKWHRHPIFAKLEDEVAYHETYPTIYHLRKKLADSSEQADLRLIYLALAHIVKYRGHFLIEGKLSTENISVKEQFQQFMIIYNQTFVNGESPLPESVLIEEELTEKASRTKKSEKVLQQFPQEKANGLFGQFLKLMVGNKADFKKVFGLEEEAKITYASESYEEDLEGILAKVGDEYSDVFLAAKNVYDAVELSTILADSDKKSHAKLSSSMIVRFTEHQEDLKNFKRFIRENCPDEYDNLFKNEQKDGYAGYITHAVSQLKFYQYVKKIIQDIAGAEYFLEKIAQENFLRKQRTFDNGVIPHQIHLAELQAIIHRQAAYYPFLKENQEKIEQLVTFRIPYYVGPLSKGDANTFAWLKRQSEEPIRPWNLQETVDLDQSATAFIERMTNFDTYLPSEKVLPKHSLLYEKFMVFNELTKISYTDDRGIKANFSGKEKEKIFDYLFKTRRKVKKKDIIQFYRNEYNTEIVTLSGLEEDQFNASFSTYQDLLKCGLTRAELDHPDNAEKLEDIIKILTIFEDRQRIRTQLSTFKGQFSAEVLKKLERKHYTGWGRLSKKLINGIYDKESGKTILDYLIDDGVSKHYNRNFMQLINDSQLSFKNAIQKAQSSEHEETLSETVNELAGSPAIKKGIYQSLKIVDELVAIMGYAPKRIVVEMARENQTTSTGKRRSIQRLKIVEKAMAEIGSNLLKEQPTTNEQLRDTRLFLYYMQNGKDMYTGDELSLHRLSHYDIDHIIPQSFMKDDSLDNLVLVGSTENRGKSDDVPSKEVVKDMKAYWEKLYAAGLISQRKFQRLTKGEQGGLTLEDKAHFIQRQLVETRQITKNVAGILDQRYNAKSKEKKVQIITLKASLTSQFRSIFGLYKVREVNDYHHGQDAYLNCVVATTLLKVYPNLAPEFVYGEYPKFQTFKENKATAKAIIYTNLLRFFTEDEPRFTKDGEILWSNSYLKTIKKELNYHQMNIVKKVEVQKGGFSKESIKPKGPSNKLIPVKNGLDPQKYGGFDSPIVAYTVLFTHEKGKKPLIKQEILGITIMEKTRFEQNPILFLEEKGFLRPRVLMKLPKYTLYQFPEGRRRLLASAKEAQKGNQMVLPEHLLTLLYHAKQCLLPNQSESLAYVEQHQPEFQEILERVVDFAEVHTLAKSKVQQIVKLFEANQTADVKEIAASFIQLMQFNAMGAPSTFKFFQKDIERARYTSIKEIFDATIIYQSTTGLYETRRKVVD

SEQ ID NO: 202 - protein, 1329 aa, Enterococcus faecalis
MKKDYVIGLDIGTNSVGWAVMTEDYQLVKKKMPIYGNTEKKKIKKNFWGVRLFEEGHTAEDRRLKRTARRRISRRRNRLRYLQAFFEEAMTALDENFFARLQESFLVPEDKKWHRHPIFAKLEDEVAYHETYPTIYHLRKKLADSSEQADLRLIYLALAHIVKYRGHFLIEGKLSTENISVKEQFQQFMIIYNQTFVNGESPLPESVLIEEELTEKASRTKKSEKVLQQFPQEKANGLFGQFLKLMVGNKADFKKVFGLEEEAKITYASESYEEDLEGILAKVGDEYSDVFLAAKNVYDAVELSTILADSDKKSHAKLSSSMIVRFTEHQEDLKNFKRFIRENCPDEYDNLFKNEQKDGYAGYITHAVSQLKFYQYVKKIIQDIAGAEYFLEKIAQENFLRKQRTFDNGVIPHQIHLAELQAIIHRQAAYYPFLKENQEKIEQLVTFRIPYYVGPLSKGDASTFAWLKRQSEEPIRPWNLQETVDLDQSATAFIERMTNFDTYLPSEKVLPKHSLLYEKFMVFNELTKISYTDDRGIKANFSGKEKEKIFDYLFKTRRKVKKKDIIQFYRNEYNTEIVTLSGLEEDQFNASFSTYQDLLKCGLTRAELDHPDNAEKLEDIIKILTIFEDRQRIRTQLSTFKGQFSAEVLKKLERKHYTGWGRLSKKLINGIYDKESGKTILDYLVDDGVSKHYNRNFMQLINDSQLSFKNAIQKAQSSEHEETLSETVNELAGSPAIKKGIYQSLKIVDELVAIMGYAPKRIVVEMARENQTTSTGKRRSIQRLKIVEKAMAEIGSNLLKEQPTTNEQLRDTRLFLYYMQNGKDMYTGDELSLHRLSHYDIDHIIPQSFMKDDSLDNLVLVGSTENRGKSDDVPSKEVVKDMKAYWEKLYAAGLISQRKFQRLTKGEQGGLTLEDKAHFIQRQLVETRQITKNVAGILDQRYNAKSKEKKVQIITLKASLTSQFRSIFGLYKVREVNDYHHGQDAYLNCVVATTLLKVYPNLAPEFVYGEYPKFQTFKENKATAKAIIYTNLLRFFTEDEPRFTKDGEILWSNSYLKTIKKELNYHQMNIVKKVEVQKGGFSKESIKPKGPSNKLIPVKNGLDPQKYGGFDSPIVAYTVLFTHEKGKKPLIKQEILGITIMEKTRFEQNPILFLEEKGFLRPRVLMKLPKYTLYEFPEGRRRLLASAKEAQKGNQMVLPEHLLTLLYHAKQCLLPNQSESLAYVEQHQPEFQEILERVVDFAEVHTLAKSKVQQIVKLFEANQTADVKEIAASFIQLMQFNAMGAPSTFKFFQKDIERARYTSIKEIFDATIIYQSTTGLYETRRKVVD

SEQ ID NO: 203 - protein, 1329 aa, Enterococcus faecalis
MKKDYVIGLDIGTNSVGWAVMTEDYQLVKKKMPIYGNTEKKKIKKNFWGVRLFEEGHTAEDRRLKRTARRRISRRRNRLRYLQAFFEEAMTDLDENFFARLQESFLVPEDKKWHRHPIFAKLEDEVAYHETYPTIYHLRKKLADSSEQADLRLIYLALAHIVKYRGHFLIEGKLSTENISVKEQFQQFMIIYNQTFVNGESPLPESVLIEEELTEKASRTKKSEKVLQQFPQEKANGLFGQFLKLMVGNKADFKKVFGLEEEAKITYASESYEEDLEGILAKVGDEYSDVFLAAKNVYDAVELSTILADSDKKSHAKLSSSMIVRFTEHQEDLKKFKRFIRENCPDEYDNLFKNEQKDGYAGYIAHAVSQLKFYQYVKKIIQDIAGAEYFLEKIAQENFLRKQRTFDNGVIPHQIHLAELQAIIHRQAAYYPFLKENQEKIEQLVTFRIPYYVGPLSKGDASTFAWLKRQSEEPIRPWNLQETVDLDQSATAFIERMTNFDTYLPSEKVLPKHSLLYEKFMVFNELTKISYTDDRGIKANFSGKEKEKIFDYLFKTRRKVKKKDIIQFYRNEYNTEIVTLSGLEEDQFNASFSTYQDLLKCGLTRAELDHPDNAEKLEDIIKILTIFEDRQRIRTQLSTFKGQFSAEVLKKLERKHYTGWGRLSKKLINGIYDKESGKTILDYLVDDGVSKHYNRNFMQLINDSQLSFKNAIQKAQSSEHEETLSETVNELAGSPAIKKGIYQSLKIVDELVAIMGYAPKRIVVEMARENQTTSTGKRRSIQRLKIVEKAMAEIGSNLLKEQPTTNEQLRDTRLFLYYMQNGKDMYTGDELSLHRLSHYDIDHIIPQSFMKDDSLDNLVLVGSTENRGKSDDVPSKEVVKDMKAYWEKLYAAGLISQRKFQRLTKGEQGGLTLEDKAHFIQRQLVETRQITKNVAGILNQRYNANSKEKKVQIITLKASLTSQFRSIFGLYKVREVNDYHHGQDAYLNCVVATTLLKVYPNLAPEFVYGEYPKFQTFKENKATAKAIIYTNLLRFFTEDEPRFTKDGEILWSNSYLKTIKKELNYHQMNIVKKVEVQKGGFSKESIKPKGPSNKLIPVKNGLDPQKYGGFDSPVVAYTVLFTHEKGKKPLIKQEILGITIMEKTRFEQNPILFLEEKGFLRPRVLMKLPKYTLYEFPEGRRRLLASAKEAQKGNQMVLPEHLLTLLYHAKQCLLPNQSESLAYVEQHQPEFQEILERVVDFAEVHTLAKSKVQQIVKLFEANQTADVKEIAASFIQLMQFNAMGAPSTFKFFQKDIERARYTSIKEIFDATIIYQSTTGLYETRRKVVD

SEQ ID NO: 204 - protein, 1331 aa, Enterococcus faecalis
MKKDYVIGLDIGTNSVGWAVMTEDYQLVKKKMPIYGNTEKKKIKKNFWGVRLFEEGHTAEDRRLKRTARRRISRRRNRLRYLQAFFEEAMTALDENFFARLQESFLVPEDKKWHRHPIFAKLEDEVAYHETYPTIYHLRKKLADSSEQADLRLIYLALAHIVKYRGHFLIEGKLSTENISVKEQFQQFMIIYNQTFVNGESPLPESVLIEEELTEKASRTKKSEKVLQQFPQEKANGLFGQFLKLMVGNKADFKKVFGLEEEAKIKITYASESYEEDLEGILAKVGDEYSDVFLAAKNVYDAVELSTILADSDKKSHAKLSSSMIVRFTEHQEDLKNFKRFIRENCPDEYDNLFKNEQKDGYAGYIAHAVSQLKFYQYVKKIIQDIAGAEYFLEKIAQENFLRKQRTFDNGVIPHQIHLAELQAIIHRQAAYYPFLKENQKKIEQLVTFRIPYYVGPLSKGDASTFAWLKRQSEEPIRPWNLQETVDLDQSATAFIERMTNFDTYLPSEKVLPKHSLLYEKFMVFNELTKISYTDDRGIKANFSGKEKEKIFDYLFKTRRKVKKKDIIQFYRNEYNTEIVTLSGLEEDQFNASFSTYQDLLKCGLTRAELDHPDNAEKLEDIIKILTIFEDRQRIRTQLSTFKGQFSEEVLKKLERKHYTGWGRLSKKLINGIYDKESGKTILDYLIDDGVSKHYNRNFMQLINDSQLSFKNAIQKAQSSEHEETLSETVNELAGSPAIKKGIYQSLKIVDELVAIMGYAPKRIVVEMARENQTTSTGKRRSIQRLKIVEKAMAEIGSNLLKEQPTTNEQLRDTRLFLYYMQNGKDMYTGDELSLHRLSHYDIDHIIPQSFMKDDSLDNLVLVGSTENRGKSDDVPSKEVVKKMKAYWEKLYAAGLISQRKFQRLTKGEQGGLTLEDKAHFIQRQLVETRQITKNVAGILDQRYNAKSKEKKVQIITLKASLTSQFRSIFGLYKVREVNDYHHGQDAYLNCVVATTLLKVYPNLAPEFVYGEYPKFQAFKENKATAKAIIYTNLLRFFTEDEPRFTKDGEILWSNSYLKTIKKELNYHQMNIVKKVEVQKGGFSKESIKPKGPSNKLIPVKNGLDPQKYGGFDSPVVAYTVLFTHEKGKKPLIKQEILGITIMEKTRFEQNPILFLEEKGFLRPRVLMKLPKYTLYEFPEGRRRLLASAKEAQKGNQMVLPEHLLTLLYHAKQCLLPNQSESLAYVEQHQPEFQEILERVVDFAEVHTLAKSKVQQIVKLFEANQTADVKEIAASFIQLMQFNAMGAPSTFKFFQKDIERARYTSIKEIFDATIIYQSTTGLYETRRKVVD

SEQ ID NO: 205 - protein, 1329 aa, Enterococcus faecalis
MKKDYVIGLDIGTNSVGWAVMTEDYQLVKKKMPIYGNTEKKKIKKNFWGVRLFEEGHTAEDRRLKRTARRRISRRRNRLRYLQAFFEEAMTALDENFFARLQESFLVPEDKKWHRHPIFAKLEDEVAYHETYPTIYHLRKKLADSSEQADLRLIYLALAHIVKYRGHFLIEGKLSTENISVKEQFQQFMIIYNQTFVNGESPLPESVLIEEELTEKASRTKKSEKVLQQFPQEKANGLFGQFLKLMVGNKADFKKVFGLEEEAKITYASESYEEDLEGILAKVGDEYSDVFLAAKNVYDAVELSTILADSDKKSHAKLSSSMIVRFTEHQEDLKKFKRFIRENCPDEYDNLFKNEQKDGYAGYIAHAVSQLKFYQYVKKIIQDIAGAEYFLEKIAQENFLRKQRTFDNGVIPHQIHLAELQAIIHRQAAYYPFLKENQEKIEQLVTFRIPYYVGPLSKGDASTFAWLKRQSEEPIRPWNLQETVDLDQSATAFIERMTNFDTYLPSEKVLPKHSLLYEKFMVFNELTKISYTDDRGIKANFSGKEKEKIFDYLFKTRRKVKKKDIIQFYRNEYNTEIVTLSGLEEDQFNASFSTYQDLLKCGLTRAELDHPDNAEKLEDIIKILTIFEDRQRIRTQLSTFKGQFSAEVLKKLERKHYTGWGRLSKKLINGIYDKESGKTILGYLIDDGVSKHYNRNFMQLINDSQLSFKNAIQKAQSSEHEETLSETVNELAGSPAIKKGIYQSLKIVDELVAIMGYAPKRIVVEMARENQTTSTGKRRSIQRLKIVEKAMAEIGSNLLKEQPTTNEQLRDTRLFLYYMQNGKDMYTGDELSLHRLSHYDIDHIIPQSFMKDDSLDNLVLVGSTENRGKSDDVPSKEVVKDMKAYWEKLYAAGLISQRKFQRLTKGEQGGLTLEDKAHFIQRQLVETRQITKNVAGILDQRYNAKSKEKKVQIITLKASLTSQFRSIFGLYKVREVNDYHHGQDAYLNCVVATTLLKVYPNLAPEFVYGEYPKFQTFKENKATAKAIIYTNLLRFFTEDEPRFTKDGEILWSNSYLKTIKKELNYHQMNIVKKVEVQKGGFSKESIKPKGPSNKLIPVKNGLDPQKYGGFDSPIVAYTVLFTHEKGKKPLIKQEILGITIMEKTRFEQNPILFLEEKGFLRPRVLMKLPKYTLYEFPEGRRRLLASAKEAQKGNQMVLPEHLLTLLYHAKQCLLPNQSESLAYVEQHQPEFQEILERVVDFAEVHTLAKSKVQQIVKLFEANQTADVKEIAASFIQLMQFNAMGAPSTFKFFQKDIERARYTSIKEIFDATIIYQSTTGLYETRRKVVD

SEQ ID NO: 206 - protein, 1329 aa, Enterococcus faecalis
MKKDYVIGLDIGSNSVGWAVMTEDYQLVKKKMPIYGNTEKKKIKKNFWGVRLFEEGHTAEDRRLKRTARRRISRRRNRLRYLQAFFEEAMTDLDENFFARLQESFLVPEDKKWHRHPIFAKLEDEVAYHETYPTIYHLRKKLADSSEQADLRLIYLALAHIVKYRGHFLIEGKLSTENTSVKDQFQQFMVIYNQTFVNGESPLPESVLIEEELTEKASRTKKSEKVLQQFPQEKANGLFGQFLKLMVGNKADFKKVFGLEEEAKITYASESYEEDLEGILAKVGDEYSDVFLAAKNVYDAVELSTILADSDKKSHAKLSSSMIVRFTEHQEDLKNFKRFIRENCPDEYDNLFKNEQKDGYAGYITHAVSQLKFYQYVKKIIQDIAGAEYFLEKIAQENFLRKQRTFDNGVIPHQIHLAELQAIIHRQAAYYPFLKENQEKIEQLVTFRIPYYVGPLSKGDASTFAWLKRQSEEPIRPWNLQETVDLDQSATAFIERMTNFDTYLPSEKVLPKHSLLYEKFMVFNELTKISYTDDRGIKANFSGKEKEKIFDYLFKTRRKVKKKDIIQFYRNEYNTEIVTLSGLEEDQFNASFSTYQDLLKCGLTRAELDHPDNAEKLEDIIKILTIFEDRQRIRTQLSTFKGQFSAEVLKKLERKHYTGWGRLSKKLINGIYDKESGKTILDYLIDDGVSKHYNRNFMQLINDSQLSFKNAIQKAQSSEHEETLSETVNELAGSPAIKKGIYQSLKIVDELVAIMGYAPKRIVVEMARENQTTSTGKRRSIQRLKIVEKAMAEIGSNLLKEQPTTNEQLRDTRLFLYYMQNGKDMYTGDELSLHRLSHYDIDHIIPQSFMKDDSLDNLVLVGSTENRGKSDDVPSKEVVKDMKAYWEKLYAAGLISQRKFQRLTKGEQGGLTLEDKAHFIQRQLVETRQITKNVAGILDQLYNAKSKEKKVQIITLKASLTSQFRSIFGLYKVREVNDYHHGQDAYLNCVVATTLLKVYPNLAPEFVYGEYPKFQTFKENKATAKTIIYTNLMRFFTEDEPRFTKDGEILWSNSYLKTIKKELNYHQMNIVKKVEVQKGGFSKESIKPKGPSNKLIPVKNGLDPQKYGGFDSPVVAYTVLFTHEKGKKPLIKQEILGITIMEKTRFEQNPILFLEEKGFLRPRVLMKLPKYTLYEFPEGRRRLLASAKEAQKGNQMVLPEHLLTLLYHAKQCLLPNQSESLAYVEQHQPEFQEILERVVDFAEVHTLAKSKVQQIVKLFEANQTADVKEIAASFIQLMQFNAMGAPSTFKFFQKDIERARYTSIKEIFDATIIYQSTTGLYETRRKVVD

SEQ ID NO: 207 - protein, 1329 aa, Enterococcus faecalis
MKKDYVIGLDIGTNSVGWAVMTEDYQLVKKKMPIYGNTEKKKIKKNFWGVRLFEEGHTAEDRRLKRTARRRISRRRNRLRYLQAFFEEAMTALDENFFARLQESFLVPEDKKWHRHPIFAKLEDEVAYHETYPTIYHLRKKLADSSEQADLRLIYLALAHIVKYRGHFLIEGKLSTENISVKEKFQQFMIIYNQTFVNGEGPLPESVLIEEELTEKASRTKKSEKVLQQFPQEKANGLFGQFLKLMVGNKADFKKVFGLEEEAKITYASESYEEDLEGILAKVGDEYSDVFLAAKNVYDAVELSTILADSDKKSYAKLSSSMIVRFTEHQEDLKKFKRFIRENCPDEYDNLFKNEQKDGYAGYIAHAVSQLKFYQYVKKIIQDIAGAEYFLEKIAQENFLRKQRTFDNGVIPHQIHLAELQAIIHRQAAYYPFLKENQEKIEQLVTFRIPYYVGPLSKGDASTFAWLKRQSEEPIRPWNLQETVDLDQSATAFIERMTNFDTYLPSEKVLPKHSLLYEKFMVFNELTKISYTDDRGIKANFSGKEKEKIFDYLFKTRRKVKKKDIIQFYRNEYNTEIVTLSGLEEDQFNASFSTYQDLLKCGLTRAELDHPDNAEKLEDIIKILTIFEDRQRIRTQLSTFKGQFSAEVLKKLERKHYTGWGRLSKKLINGIYDKESGKTILDYLVDDGVSKHYNRNFMQLINDSQLSFKNAIQKAQSSEHEETLSETVNELAGSPAIKKGIYQSLKIVDELVAIMGYAPKRIVVEMARENQTTSTGKRRSIQRLKIVEKAMAEIGSNLLKEQPTTNEQLRDTRLFLYYMQNGKDMYTGDELSLHRLSHYDIDHIIPQSFMKDDSLDNLVLVGSTENRGKSDDVPSKEVVKDMKAYWEKLYAAGLISQRKFQRLTKGEQGGLTLEDKAHFIQRQLVETRQITKNVAGILDQRYNAKSKEKKVQIITLKASLTSQFRSIFGLYKVREVNDYHHGQDAYLNCVVATTLLKVYPNLAPEFVYGEYPKFQTFKENKATAKAIIYTNLLRFFTEDEPRFTKDGEILWSNSYLKTIKKELNYHQMNIVKKVEVQKGGFSKESIKPKGPSNKLIPVKNGLDPQKYGGFDSPIVAYTVLFTHEKGKKPLIKQEILGITIMEKTRFEQNPILFLEEKGFLRPRVLMKLPKYTLYEFPEGRRRLLASAKEAQKGNQMVLPEHLLTLLYHAKQCLLPNQSESLAYVEQHQPEFQEILERVVDFAEVHTLAKSKVQQIVKLFEANQTADVKEIAASFIQLMQFNAMGAPSTFKFFQKDIERARYTSIKEIFDATIIYQSTTGLYETRRKVVD

SEQ ID NO: 208 - protein, 1329 aa, Enterococcus faecalis
MKKDYVIGLDIGTNSVGWAVMTEDYQLVKKKMPIYGNTEKKKIKKNFWGVRLFEEGHTAEDRRLKRTARRRISRRRNRLRYLQAFFEEAMTALDENFFARLQESFLVPEDKKWHRHPIFAKLEDEVAYHETYPTIYHLRKKLADSSEQADLRLIYLALAHIVKYRGHFLIEGKLSTENISVKDQFQQFMVIYNQTFVNGESPLPESVLIEEELTEKASRTKKSEKVLQQFPQEKANGLFGQFLKLMVGNKADFKKVFGLEEEAKITYASESYEEDLEGILAKVGDEYSDVFLAAKNVYDAVELSTILADSDKKSHAKLSSSMIVRFTEHQEDLKNFKRFIRENCPDEYDNLFKNEQKDGYAGYIAHAVSQLKFYQYVKKIIQDIAGAEYFLEKIAQENFLRKQRTFDNGVIPHQIHLAELQAIIHRQAAYYPFLKENQKKIEQLVTFRIPYYVGPLSKGDASTFAWLKRQSEEPIRPWNLQETVDLDQSATAFIERMTNFDTYLPSEKVLPKHSLLYEKFMVFNELTKISYTDDRGIKANFSGKEKEKIFDYLFKTRRKVKKKDIIQFYRNEYNTEIVTLSGLEEDQFNASFSTYQDLLKCGLTRAELDHPDNAEKLEDIIKILTIFEDRQRIRTQLSTFKGQFSAEVLKKLERKHYTGWGRLSKKLINGIYDKESGKTILDYLIDDGVSKHYNRNFMQLINDSQLSFKNAIQKAQSSEHEETLSETVNELAGSPAIKKGIYQSLKIVDELVAIMGYAPKRIVVEMARENQTTSTGKRRSIQRLKIVEKAMAEIGSNLLKEQPTTNEQLRDTRLFLYYMQNGKDMYTGDELSLHRLSHYDIDHIIPQSFMKDDSLDNLVLVGSTENRGKSDDVPSKEVVKKMKAYWEKLYAAGLISQRKFQRLTKGEQGGLTLEDKAHFIQRQLVETRQITKNVAGILDQRYNAKSKEKKVQIITLKASLTSQFRSIFGLYKVREVNDYHHGQDAYLNCVVATTLLKVYPNLAPEFVYGEYPKFQAFKENKAMAKAIIYTNLLRFFTEDEPRFTKDGEILWSNSYLKTIKKELNYHQMNIVKKVEVQKGGFSKESIKPKGPSNKLIPVKNGLDPQKYGGFDSPVVAYTVLFTHEKGKKPLIKQEILGITIMEKTRFEQNPILFLEEKGFLRPRVLMKLPKYTLYEFPEGRRRLLASAKEAQKGNQMVLPERLLTLLYHAKQCLLPNQSESLAYVEQHQPEFQEILERVVDFAEVHTLAKSKVQQIVKLFEANQTADVKEIAASFIQLMQFNAMGAPSTFKFFQKDIERARYTSIKEIFDATIIYQSTTGLYETRRKVVD

SEQ ID NO: 209 - protein, 1329 aa, Enterococcus faecalis
MKKDYVIGLDIGTNSVGWAVMTEDYQLVKKKMPIYGNTEKKKIKKNFWGVRLFEEGHTAEDRRLKRTARRRISRRRNRLRYLQAFFEEAMTALDENFFARLQESFLVPEDKKWHRHPIFAKLEDEVAYHETYPTIYHLRKKLADSSEQADLRLIYLALAHIVKYRGHFLIEGKLSTENISVKEQFQQFMIIYNQTFVNGESPLPESVLIEEELTEKASRTKKSEKVLQQFPQEKANGLFGQFLKLMVGNKADFKKVFGLEEEAKITYASESYEEDLEGILAKVGDEYSDVFLAAKNVYDAVELSTILADSDKKSHAKLSSSMIVRFTEHQEDLKKFKRFIRENCPDEYDNLFKNEQKDGYAGYIAHAVSQLKFYQYVKKIIQDIAGAEYFLEKIAQENFLRKQRTFDNGVIPHQIHLAELQAIIHRQAAYYPFLKENQEKIEQLVTFRIPYYVGPLSKGDASTFAWLKRQNEKPIRPWNLQETVDLDQSATAFIERMTNFDTYLPSEKVLPKHSLLYEKFMVFNELTKISYTDDRGIKANFSGKEKEKIFDYLFKTRRKVKKKDIIQFYRNEYNTEIVTLSGLEEDQFNASFSTYQDLLKCGLTRAELDHPDNAEKLEDIIKILTIFEDRQRIRTQLSTFKGQFSAEVLKKLERKHYTGWGRLSKKLINGIYDKESGKTILDYLIDDGVSKHYNRNFMQLINDSQLSFKNAIQKAQSSEHEETLSETVNELAGSPAIKKGIYQSLKIVDELVAIMGYAPKRIVVEMARENQTTSTGKRRSIQRLKIVEKAMAEIGSNLLKEQPTTNEQLRDTRLFLYYMQNGKDMYTGDELSLHRLSHYDIDHIIPQSFMKDDSLDNLVLVGSTENRGKSDDVPSKEVVKKMKAYWEKLYAAGLISQRKFQRLTKGEQGGLTLEDKAHFIQRQLVETRQITKNVAGILDQRYNAKSKEKKVQIITLKASLTSQFRSIFGLYKVREVNDYHHGQDAYLNCVVATTLLKVYPNLAPEFVYGEYPKFQAFKENKATAKAIIYTNLMRFFTEVEPRFTKDGEILWSNSYLKTIKKELNYHQMNIVKKVEVQKGGFSKESIKPKGPSNKLIPVKNGLDPQKYGGFDSPVVAYTVLFTHEKGKKPLIKQEILGITIMEKTKFEQNPILFLEEKGFLRPRVLMKLPKYTLYEFPEGRRRLLASAKEAQKGNQMVLPEHLLTLLYHAKQCLLPNQSESLAYVEQHQPEFQEILERVVDFAEVHTLAKSKVQQIVKLFETNQTADVKEIAASFIQLMQFNAMGAPSTFKFFQKDIERARYTSIKEIFDATIIYQSTTGLYETRRKVVD

SEQ ID NO: 210 - protein, 1329 aa, Enterococcus faecalis
MKKDYVIGLDIGTNSVGWAVMTEDYQLVKKKMPIYGNTEKKKIKKNFWGVRLFEEGHTAEDRRLKRTARRRISRRRNRLRYLQAFFEEAMTALDENFFARLQESFLVPEDKKWHRHPIFAKLEDEVAYHETYPTIYHLRKKLADSSEQADLRLIYLALAHIVKYRGHFLIEGKLSTENISVKEQFQQFMIIYNQTFVNGESPLPESVLIEEELTEKASRTKKSEKVLQQFPQEKANGLFGQFLKLMVGNKADFKKVFGLEEEAKITYASESYEEDLEGILAKVGDEYSDVFLAAKNVYDAVELSTILADSDKKSHAKLSSSMIVRFTEHQEDLKNFKRFIRENCPDEYDNLFKNEQKDGYAGYIAHAVSQLKFYQYVKKIIQDIAGAEYFLEKIAQENFLRKQRTFDNGVIPHQIHLAELQAIIHRQAAYYPFLKENQKKIEQLVTFRIPYYVGPLSKGDASTFAWLKRQSEEPIRPWNLQETVDLDQSATAFIERMTNFDTYLPSEKVLPKHSLLYEKFMVFNELTKISYTDDRGIKANFSGKEKEKIFDYLFKTRRKVKKKDIIQFYRNEYNTEIVTLSGLEEDQFNASFSTYQDLLKCGLTRAELDHPDNAEKLEDIIKILTIFEDRQRIRTQLSTFKGQFSEEVLKKLERKHYTGWGRLSKKLINGIYDKESGKTILDYLIDDGVSKHYNRNFMQLINDSQLSFKNAIQKAQSSEHEETLSETVNELAGSPAIKKGIYQSLKIVDELVAIMGYAPKRIVVEMARENQTTSTGKRRSIQRLKIVEKAMAEIGSNLLKEQPTTNEQLRDTRLFLYYMQNGKDMYTGDELSLHRLSHYDIDHIIPQSFMKDDSLDNLVLVGSTENRGKSDDVPSKEVVKKMKAYWEKLYAAGLISQRKFQRLTKGEQGGLTLEDKAHFIQRQLVETRQITKNVAGILDQRYNAKSKEKKVQIITLKASLTSQFRSIFGLYKVREVNDYHHGQDAYLNCVVATTLLKVYPNLAPEFVYGEYPKFQAFKENKATAKAIIYTNLLRFFTEDEPRFTKDGEILWSNSYLKTIKKELNYHQMNIVKKVEVQKGGFSKESIKPKGPSNKLIPVKNGLDPQKYGGFDSPVVAYTVLFTHEKGKKPLIKQEILGITIMEKTRFEQNPILFLEEKGFLRPRVLMKLPKYTLYEFPEGRRRLLASAKEAQKGNQMVLPEHLLTLLYHAKQCLLPNQSESLAYVEQHQPEFQEILERVVDFAEVHTLAKSKVQQIVKLFEANQTADVKEIAASFIQLMQFNAMGAPSTFKFFQKDIERARYTSIKEIFDATIIYQSTTGLYETRRKVVD

SEQ ID NO: 211 - protein, 1328 aa, Enterococcus faecium
MKKEYTIGLDIGTNSVGWSVLTDDYRLVSKKMKVAGNTEKSSTKKNFWGVRLFDEGQTAEARRSKRTARRRLARRRQRILELQKIFAPEILKIDEHFFARLNESFLVLDEKKQSRHPVFATIKQEKSYHQTYPTIYHLRQALADSSEKADIRLVYLAMAHLLKYRGHFLIEGELNTENSSVTETFRQFLSTYNQQFSEADKLDEAVDCSFVFTEKMSKTKKAETLLKYFPHEKSNGYLSQFIKLMVGNQGNFKNVFGLEEAKLQFSKETYEEDLEELLEKIGDDYIDLFVQAKNVYDAVLLSEILSDSTKNTRAKLSAGMIRRYDAHKEDLVLLKRFVKENLPKKYRAFFGDNSVNGYAGYIEGHATQEDFYKFVKKELTGIRGSEVFLTKIEQENFLRKQRTFDNGVIPHQIHLTELRAIIANQKKHYPFLKEEQEKLESLLTFKIPYYVGPLAKKQENSPFAWLIRKSEEKIKPWNLPEIVDMEGSAVRFIERMINTDMYMPHNKVLPKNSLLYQKFSIYNELTKVRYQDERGQMNYFSSIEKKEIFHELFEKNRKVTKKDLQEFLYLKYDIKHAELSGIEKAFNASYTTYHDFLTMSENKQWLEDPELASMFEEIIKTLTVFEDREMIKTRLSHHEATLGKHIIKKLTKKHYTGWGRLSKELIQGIRDKQSNKTILDYLIDDDFPHHRNRNFMQLINDDSLSFKKEIKKAQMITDTENLEEIVKELTGSPAIKKGILQSLKIVDEIVGIMGYEPANIVVEMARENQTTGRGLKSSRPRLKALEESLKDFGSQLLKEYPTDNSSLQKDRLYLYYLQNGRDMYTGAPLDIHRLSDYDIDHIIPRSFTTDNSIDNKVLVSSKENRLKKDDVPSEKVVKKMRSFWYDLYSSKLISKRKLDNLTKIKLTEEDKAGFIKRQLVETRQITKHVAGILHHRFNKAEDTNEPIRKVRIITLKSALVSQFRNRFGIYKVREINEYHHAHDAYLNGVVALALLKKYPQLAPEFVYGEYLKFNAHKANKATVKKEFYSNIMKFFESDTPVCDENGEIFWDKSKSIAQVKKVINHHHMNIVKKTEIQKGGFSKETVEPKKDSSKLLPRKNNWDPAKYGGLGSPNVAYTVAFTYEKGKARKRTNALEGITIMEREAFEQSPVLFLKNKGYEQAEIEMKLPKYALFELENGRKRMVASKEAQKANSFLLPEHLVTLLYHAKQYDEISHKESFDYVNEHHKEFSEVFARVLEFAGKYTLAEKNIEKLEKIYKENQTDDLAKLASSFVNLMQFNAMGAPADFKFFDVTIPRKRYTSLTEIWQSTIIHQSITGLYETRIRMGK

SEQ ID NO: 212 - protein, 1329 aa, Enterococcus faecium
MKKEYTIGLDIGTNSVGWSVLTDDYRLVSKKMKVAGNTEKSSTKKNFWGVRLFDEGQTAEARRSKRTARRRLARRRQRILELQKIFAPEILKIDEHFFARLNESFLVPDEKKQSRHPVFATIKQEKSYHQTYPTIYHLRQALADSSEKADIRLVYLAMAHLLKYRGHFLIEGELNTENSSVTETFRQFLSTYNQQFSEAGKLDEAVDCSFVFTEKMSKTKKAETLLKYFPHEKSNGYLSQFIKLMVGNQGNFKNVFGLEEEAKLQFSKETYEEDLEELLEKIGDDYIDLFVQAKNVYDAVLLSEILSDSTKNTRAKLSAGMIRRYDAHKEDLVLLKRFVKENLPKKYRAFFGDNSVNGYAGYIEGHATQEAFYKFVKKELTGIRGSEVFLTKIEQENFLRKQRTFDNGVIPHQIHLSELRAIIANQKKHYPFLKEEQEKLESLLTFKIPYYVGPLAKKQENSPFAWLIRKSEEKIKPWNLPEIVDMEGSAVRFIERMINTDMYMPHNKVLPKNSLLYQKFSIYNELTKVRYQDERGQMNYFSSIEKKEIFHELFEKNRKVTKKDLQEFLYLKYDIKHAELSGIEKAFNASYTTYHDFLTMSENKQWLEDPELASMFEEIIKTLTVFEDREMIKTRLSHHEATLGKHIIKKLTKKHYTGWGRLSKELIQGIRDKQSNKTILDYLIDDDFPHHRNRNFMQLINDDSLSFKKEIKKAQMITDTENLEEIVKELTGSPAIKKGILQSLKIVDEIVGIMGYEPANIVVEMARENQTTGRGLKSSRPRLKALEESLKDFGSQLLKEYPTDNSSLQKDRLYLYYLQNGRDMYTGAPLDIHRLSDYDIDHIIPRSFTTDNSIDNKVLVSSKENRLKKDDVPSEKVVKKMRSFWYDLYSSKLISKRKLDNLTKIKLTEEDKAGFIKRQLVETRQITKHVAGILHHRFNKAEDTNDPIRKVRIITLKSALVSQFRNRFGIYKVREINEYHHAHDAYLNGVVALALLKKYPQLAPEFVYGEYLKFNAHKANKATVKKEFYSNIMKFFESDTPVCDENGEIFWDKSKSIAQVKKVINHHHMNIVKKTEIQKGGFSKETVEPKKDSSKLLPRKNNWDPAKYGGLGSPNVAYTVAFTYEKGKARKRTNALEGITIMEREAFEQSPVLFLKNKGYEQAEIEMKLPKYALFELENGRKRMVASKEAQKANSFLLPEHLVTLLYHAKQYDEISHKESFDYVNEHHKEFSEVFARVLEFAGKYTLAEKNIEKLEKIYKENQTDDLAKLASSFVNLMQFNAMGAPADFKFFDVTIPRKRYTSLTEIWQSTIIHQSITGLYETRIRMGK

SEQ ID NO: 213 - protein, 1329 aa, Enterococcus faecium
MKKEYTIGLDIGTNSVGWSVLTDDYRLVSKKMKVAGNTEKSSTKKNFWGVRLFDEGQTAEARRSKRTARRRLARRRQRILELQKIFAPEILKIDEHFFARLNESFLVLDEKKQSRHPVFATIKQEKSYHQTYPTIYHLRQALADSSEKADIRLVYLAMAHLLKYRGHFLIEGELNTENSSVTETFRQFLSTYNQQFSEADKLDEAVDCSFVFTEKMSKTKKAETLLKYFPHEKSNGYLSQFIKLMVGNQGNFKNVFGLEEEAKLQFSKETYEEDLEELLEKIGDDYIDLFVQAKNVYDAVLLSEILSDSTKNTRAKLSAGMIRRYDAHKEDLVLLKRFVKENLPKKYRAFFGDNSVNGYAGYIEGHATQEDFYKFVKKELTGIRGSEVFLTKIEQENFLRKQRTFDNGVIPHQIHLTELRAIIANQKKHYPFLKEEQEKLESLLTFKIPYYVGPLAKKQENSPFAWLIRKSEEKIKPWNLPEIVDMEGSAVRFIERMNNTDMYIPHNKVLPKNSLLYQKFSIYNELTKVRYQDERGQMNYFSSIEKKEIFHELFEKNRKVTKKDLQEFLYLKYDIKHAELSGIEKAFNASYTTYHDFLTMSENKQWLEDPELASMFEEIIKTLTVFEDREMIKTRLSHHEATLGKHIIKKLTKKHYTGWGRLSKELIQGIRDKQSNKTILDYLIDDDFPHHRNRNFMQLINDDSLSFKKEIKKAQMITDTENLEEIVKELTGSPAIKKGILQSLKIVDEIVGIMGYEPANIVVEMARENQTTGRGLKSSRPRLKALEESLKDFGSQLLKEYPTDNSSLQKDRLYLYYLQNGRDMYTGAPLDIHRLSDYDIDHIIPRSFTTDNSIDNKVLVSSKENRLKKDDVPSEKVVKKMRSFWYDLYSSKLISKRKLDNLTKIKLTEEDKAGFIKRQLVETRQITKHVAGILHHRFNKAEDTNEPIRKVRIITLKSALVSQFRNRFGIYKVREINEYHHAHDAYLNGVVALALLKKYPQLAPEFVYGEYLKFNAHKANKATVKKEFYSNIMKFFESDTPVCDENGEIFWDKSKSIAQVKKVINHHHMNIVKKTEIQKGGFSKETVEPKKDSSKLLPRKNNWDPAKYGGLGSPNVAYTVAFTYEKGKARKRTNALEGITIMEREAFEQSPVLFLKNKGYEQAEIEMKLPKYALFELENGRKRMVASKEAQKANSFLLPEHLVTLLYHAKQYDEISHKESFDYVNEHHKEFSEVFARVLEFAGKYTLAEKNIEKLEKIYKENQTDDLAKLASSFVNLMQFNAMGAPADFKFFDVTIPRKRYTSLTEIWQSTIIHQSITGLYETRIRMGK

SEQ ID NO: 214 - protein, 1329 aa, Enterococcus faecium
MKKEYTIGLDIGTNSVGWSVLTDDYRLVSKKMKVAGNTEKSSTKKNFWGVRLFDEGQTAEARRSKRTARRRLARRRQRILELQKIFAPEILKIDEHFFARLNESFLVLDEKKQSRHPVFATIKQEKSYHQTYPTIYHLRQALADSSEKADIRLVYLAMAHLLKYRGHFLIEGELNTENSSVTETFRQFLSTYNQQFSEADKLDEAVDCSFVFTEKMSKTKKAETLLKYFPHEKSNGYLSQFIKLMVGNQGNFKNVFGLEEEAKLQFSKETYEEDLEELLEKIGDDYIDLFVQAKNVYDAVLLSEILSDSTKNTRAKLSAGMIRRYDAHKEDLVLLKRFVKENLPKKYRAFFGDNSVNGYAGYIEGHATQEDFYKFVKKELTGIRGSEVFLTKIEQENFLRKQRTFDNGVIPHQIHLTELRAIIANQKKHYPFLKEEQEKLESLLTFKIPYYVGPLAKKQENSPFAWLIRKSEEKIKPWNLPEIVDMEGSAVRFIERMINTDMYIPHNKVLPKNSLLYQKFSIYNELTKVRYQDERGQMNYFSSIEKKEIFHELFEKNRKVTKKDLQEFLYLKYDIKHAELSGIEKAFNASYTTYHDFLTMSENKQWLEDPELASMFEEIIKTLTVFEDREMIKTRLSHHEATLGKHIIKKLTKKHYTGWGRLSKELIQGIRDKQSNKTILDYLIDDDFPHHRNRNFMQLINDDSLSFKKEIKKAQMITDTENLEEIVKELTGSPAIKKGILQSLKIVDEIVGIMGYEPANIVVEMARENQTTGRGLKSSRPRLKALEESLKDFGSQLLKEYPTDNSSLQKDRLYLYYLQNGRDMYTGAPLDIHRLSDYDIDHIIPRSFTTDNSIDNKVLVSSKENRLKKDDVPSEKVVKKMRSFWYDLYSSKLISKRKLDNLTKIKLTEEDKAGFIKRQLVETRQITKHVAGILHHRFNKAEDTNEPIRKVRIITLKSALVSQFRNRFGIYKVREINEYHHAHDAYLNGVVALALLKKYPQLAPEFVYGEYLKFNAHKANKATVKKEFYSNIMKFFESDTPVCDENGEIFWDKSKSIAQVKKVINHHHMNIVKKTEIQKGGFSKETVEPKKDSSKLLPRKNNWDPAKYGGLGSPNVAYTVAFTYEKGKARKRTNALEGITIMEREAFEQSPVLFLKNKGYEQAEIEMKLPKYALFELENGRKRMVASKEAQKANSFLLPEHLVTLLYHAKQYDEISHKESFDYVNEHHKEFSEVFARVLEFAGKYTLAEKNIEKLEKIYKENQTDDLAKLASSFVNLMQFNAMGAPADFKFFDVTIPRKRYTSLTEIWQSTIIHQSITGLYETRIRMGK

SEQ ID NO: 215 - protein, 1328 aa, Enterococcus faecium
MKKEYTIGLDIGTNSVGWSVLTDDYRLVSKKMKVAGNTEKSSTKKNFWGVRLFDEGQTAEARRSKRTARRRLARRRQRILELQKIFAPEILKIDEHFFARLNESFLVLDEKKQSRHPVFATIKQEKSYHQTYPTIYHLRQALADSSEKADIRLVYLAMAHLLKYRGHFLIEGELNTENSSVTETFRQFLSTYNQQFSEADKLDEAVDCSFVFTEKMSKTKKAETLLKYFPHEKSNGYLSQFIKLMVGNQGNFKNVFGLEEAKLQFSKETYEEDLEELLEKIGDDYIDLFVQAKNVYDAVLLSEILSDSTKNTRAKLSAGMIRRYDAHKEDLVLLKRFVKENLPKKYRAFFGDNSVNGYAGYIEGHATQEDFYKFVKKELTGIRGSEVFLTKIEQENFLRKQRTFDNGVIPHQIHLTELRAIIANQKKHYPFLKEEQEKLESLLTFKIPYYVGPLAKKQENSPFAWLIRKSEEKIKPWNLPEIVDMEGSAVRFIERMINTDMYIPHNKVLPKNSLLYQKFSIYNELTKVRYQDERGQMNYFSSIEKKEIFHELFEKNRKVTKKDLQEFLYLKYDIKHAELSGIEKAFNASYTTYHDFLTMSENKQWLEDPELASMFEEIIKTLTVFEDREMIKTRLSHHEATLGKHIIKKLTKKHYTGWGRLSKELIQGIRDKQSNKTILDYLIDDDFPHHRNRNFMQLINDDSLSFKKEIKKAQMITDTENLEEIVKELTGSPAIKKGILQSLKIVDEIVGIMGYEPANIVVEMARENQTTGRGLKSSRPRLKALEESLKDFGSQLLKEYPTDNSSLQKDRLYLYYLQNGRDMYTGAPLDIHRLSDYDIDHIIPRSFTTDNSIDNKVLVSSKENRLKKDDVPSEKVVKKMRSFWYDLYSSKLISKRKLDNLTKIKLTEEDKAGFIKRQLVETRQITKHVAGILHHRFNKAEDTNEPIRKVRIITLKSALVSQFRNRFGIYKVREINEYHHAHDAYLNGVVALALLKKYPQLAPEFVYGEYLKFNAHKANKATVKKEFYSNIMKFFESDTPVCDENGEIFWDKSKSIAQVKKVINHHHMNIVKKTEIQKGGFSEETVEPKKDSSKLLPRKNNWDPAKYGGLGSPNVAYTVAFTYEKGKARKRTNALEGITIMEREAFEQSPVLFLKNKGYEQAEIEMKLPKYALFELENGRKRMVASKEAQKANSFLLPEHLVTLLYHAKQYDEISHKESFDYVNEHHKEFSEVFARVLEFAGKYTLAEKNIEKLEKIYKENQTDDLAKLASSFVNLMQFNAMGAPADFKFFDVTIPRKRYTSLTEIWQSTIIHQSITGLYETRIRMGK

SEQ ID NO: 216 - protein, 1329 aa, Enterococcus faecium
MKKEYTIGLDIGTNSVGWSVLTDDYRLVSKKMKVAGNTEKSSTKKNFWGVRLFDEGQTAEARRSKRTARRRLARRRQRILELQKIFAPEILKIDEHFFARLNESFLVLDEKKQSRHPVFATIKQEKSYHQTYPTIYHLRQALADSSEKADIRLVYLAMAHLLKYRGHFLIEGELNTENSSVTETFRQFLSTYNQQFSEADKLDEAVDCSFVFTEKMSKTKKAETLLKYFPHEKSNGYLSQFIKLMVGNQGNFKNVFGLEEEAKLQFSKETYEEDLEELLEKIGDDYIDLFVQAKNVYDAVLLSEILSDSTKNTRAKLSAGMIRRYDAHKEDLVLLKRFVKENLPKKYRAFFGDNSVNGYAGYIEGHATQEDFYKFVKKELTGIRGSEVFLTKIEQENFLRKQRTFDNGVIPHQIHLTELRAIIANQKKHYPFLKEEQEKLESLLTFKIPYYVGPLAKKQENSPFAWLIRKSEEKIKPWNLPEIVDMEGSAVRFIERMINTDMYMPHNKVLPKNSLLYQKFSIYNELTKVRYQDERGQMNYFSSIEKKEIFHELFEKNRKVTKKDLQEFLYLKYDIKHAELSGIEKAFNASYTTYHDFLTMSENKQWLEDPELASMFEEIIKTLTVFEDREMIKTRLSHHEATLGKHIIKKLTKKHYTGWGRLSKELIQGIRDKQSNKTILDYLIDDDFPHHRNRNFMQLINDDSLSFKKEIKKAQMITDTENLEEIVKELTGSPAIKKGILQSLKIVDEIVGIMGYEPANIVVEMARENQTTGRGLKSSRPRLKALEESLKDFGSQLLKEYPTDNSSLQKDRLYLYYLQNGRDMYTGAPLDIHRLSDYDIDHIIPRSFTTDNSIDNKVLVSSKENRLKKDDVPSEKVVKKMRSFWYDLYSSKLISKRKLDNLTKIKLTEEDKAGFIKRQLVETRQITKHVAGILHHRFNKAEDTNEPIRKVRIITLKSALVSQFRNRFGIYKVREINEYHHAHDAYLNGVVALALLKKYPQLAPEFVYGEYLKFNAHKANKATVKKEFYSNIMKFFESDTPVCDENGEIFWDKSKSIAQVKKVINHHHMNIVKKTEIQKGGFSKETVEPKKDSSKLLPRKNNWDPAKYGGLGSPNVAYTVAFTYEKGKARKRTNALEGITIMEREAFEQSPVLFLKNKGYEQAEIEMKLPKYALFELENGRKRMVASKEAQKANSFLLPEHLVTLLYHAKQYDEISHKESFDYVNEHHKEFSEVFARVLEFAGKYTLAEKNIEKLEKIYKENQTDDLAKLASSFVNLMQFNAMGAPADFKFFDVTIPRKRYTSLTEIWQSTIIHQSITGLYETRIRMGK

SEQ ID NO: 217 - protein, 1329 aa, Enterococcus faecium
MKKEYTIGLDIGTNSVGWSVLTDDYRLVSKKMKVAGNTEKSSTKKNFWGVRLFDEGQTAEARRSKRTARRRLARRRQRILELQKIFAPEILKIDEHFFARLNESFLVLDEKKQSRHPVFATIKQEKSYHQTYPTIYHLRQALADSSEKADIRLVYLAMAHLLKYRGHFLIEGELNTENSSVTETFRQFLSTYNQQFSEADKLDEAVDCSFVFTEKMSKTKKAETLLKYFPHEKSNGYLSQFIKLMVGNQGNFKNVFGLEEEAKLQFSKETYEEDLEELLEKIGDDYIDLFVQAKNVYDAVLLSEILSDSTKNTRAKLSAGMIRRYDAHKEDLVLLKRFVKENLPKKYRAFFGDNSVNGYAGYIEGHATQEDFYKFVKKELTGIRGSEVFLTKIEQENFLRKQRTFDNGVIPHQIHLTELRAIIANQKKHYPFLKEEQEKLESLLTFKIPYYVGPLAKKQENSPFAWLIRKSEEKIKPWNLPEIVDMEGSAVRFIERMINTDMYIPHNKVLPKNSLLYQKFSIYNELTKVRYQDERGQMNYFSSIEKKEIFHELFEKNRKVTKKDLQEFLYLKYDIKHAELSGIEKAFNASYTTYHDFLTMSENKQWLEDPELASMFEEIIKTLTVFEDREMIKTRLSHHEATLGKHIIKKLTKKHYTGWGRLSKELIQGIRDKQSNKTILDYLIDDDFPHHRNRNCMQLINDDSLSFKKEIKKAQMITDTENLEEIVKELTGSPAIKKGILQSLKIVDEIVGIMGYEPANIVVEMARENQTTGRGLKSSRPRLKALEESLKDFGSQLLKEYPTDNSSLQKDRLYLYYLQNGRDMYTGAPLDIHRLSDYDIDHIIPRSFTTDNSIDNKVLVSSKENRLKKDDVPSEKVVKKMRSFWYDLYSSKLISKRKLDNLTKIKLTEEDKAGFIKRQLVETRQITKHVAGILHHRFNKAEDTNEPIRKVRIITLKSALVSQFRNRFGIYKVREINEYHHAHDAYLNGVVALALLKKYPQLAPEFVYGEYLKFNAHKANKATVKKEFYSNIMKFFESDTPVCDENGEIFWDKSKSIAQVKKVINHHHMNIVKKTEIQKGGFSKETVEPKKDSSKLLPRKNNWDPTKYGGLGSPNVAYTVAFTYEKGKARKRTNALEGITIMEREAFEQSPVLFLKNKGYEQAEIEMKLPKYALFELENGRKRMVASKEAQKANSFLLPEHLVTLLYHAKQYDEISHKESFDYVNEHHKEFSEVFARVLEFAGKYTLAEKNIEKLEKIYKENQTDDLAKLASSFVNLMQFNAMGAPADFKFFDVTIPRKRYTSLTEIWQSTIIHQSITGLYETRIRMGK

SEQ ID NO: 218 - protein, 1329 aa, Enterococcus faecium
MTKDYTIGLDIGTNSVGWAVLTDDYQLMKRKMSVHGNTEKKKIKKNFWGARLFDEGQTAEFRRTKRTNRRRLARRKYRLSKLQDLFAEELCKQDDCFFVRLEESFLVPEEKQYKPASIFPTLEEEKEYYQKYPTIYHLRQKLVDSTEKEDLRLVYLALAHLLKYRGHFLFEGDLDTENTSIEESFRVFLEQYSKQSDQPLIVHQPVLTILTDKLSKTKKVEEILKYYPTEKINSFFAQCLKLIVGNQANFKRIFDLEAEVKLQFSKETYEEDLESLLEKIGDEYLDIFLQAKKVHDAILLSEIISSTVKHTKAKLSSGMVERYERHKADLAKFKQFVKENVPQKATVFFKDTTKNGYAGYIKGKTTQEEFYKFVKKELSGVVGSEPFLEKIDQETFLLKQRTYTNGVIPHQVHLIELKAIIDQQKQHYPFLEEAGPKIIALFKFRIPYYVGPLAKEQEASSFAWIERKTAEKINPWNFSEVVDIEKSAMRFIQRMTKQDTYLPTEKVLPKNSLLYQKYMIFNELTKVSYKDERGVKQYFSGDEKQQIFKQLFQKERGKITVKKLQNFLYTHYHIENAQIFGIEKAFNASYSTYHDFMKLAKTNEWLEQPEMEPIFEDIVKILTIFEDRQMIKHQLSKYQEVFGEKLLKEFARKHYTGWGRFSAKLIHGIRDRKTNKTILDYLIDDDVPANRNRNLMQLINDEHLSFKEEIAKATVFSKHKSLVDVIQDLPGSPAIKKGIWQSLKIVEELIAIIGYKPKNIVIEMARENQKTHRTSPRLKALENGLKQIGSTLLKEQPTDNKALQKERLYLYYLQNGRDMYTGEPLEIENLHQYEVDHIIPRSFIVDNSIDDKVLVASKQNQKKRDDVPKKQIVNEQRIFWNQLKEAKLISTKKYAYLTKIELTPEDKARFIQRQLVETRQITKHVANILHQSFNQEEEGTDCDGVQIITLKATLTSQFRQTFGLYKVREINPHHHAHDAYLNGFIANVLLKRYPKLAPEFVYGKYVKYSLARENKATAKKEFYSNILKFLESDEPFCDENGEIYWEKSHHLPRIKKVLSSHQVNVVKKVEQQKGGFYKETVNSKEKPDKLIERKNNWDVTKYGGFGSPVIAYAIAFVYAKGKTQKKTRAIEGITIMEQAAFEKDPTTFLKEKGFPQVTEFIKLPKYTLFEFDNGRRRFLASKESQKGNPFILSDQLVTLLYHAQHYDKITYQESFDYVNTHLSDFSAILTEVLAFAEKYTLADKNIERIQELYEENKYGETSMIAQSFLQLLQFNAIGAPADFKFFGVTIPRKRYTSLTEIWDATIIYQSVTGLYETRIRMGDLWAGEQ

SEQ ID NO: 219 - protein, 1329 aa, Enterococcus faecium
MKKEYTIGLDIGTNSVGWSVLTDDYRLVSKKMKVAGNTEKSSTKKNFWGVRLFDEGQTAEARRSKRTARRRLARRRQRILELQKIFAPEILKIDEHFFARLNESFLVLDEKKQSRHPVFATIKQEKSYHQTYPTIYHLRQALADSSEKADIRLVYLAMAHLLKYRGHFLIEGELNTENSSVTETFRQFLSTYNQQFSEADKLDEAVDCSFVFTEKMSKTKKAETLLKYFPHEKSNGYLSQFIKLMVGNQGNFKNVFGLEEEAKLQFSKETYEEDLEELLEKIGDDYIDLFVQAKNVYDAVLLSEILSDSTKNTRAKLSAGMIRRYDAHKEDLVLLKRFVKENLPKKYRAFFGDNSVNGYAGYIEGHATQEDFYKFVKKELTGIRGSEVFLTKIEQENFLRKQRTFDNGVIPHQIHLTELRAIIANQKKHYPFLKEEQEKLESLLTFKIPYYVGPLAKKQENSPFAWLIRKSEEKIKPWNLPEIVDMEGSAVRFIERMINTDMYMPHNKVLPKNSLLYQKFSIYNELTKVRYQDERGQMNYFSSIEKKEIFHELFEKNRKVTKKDLQEFLYLKYDIKHAELSGIEKAFNASYTTYHDFLTMSENKQWLEDPELASMFEEIIKTLTVFEDREMIKTRLSHHEATLGKHIIKKLTKKHYTGWGRLSKELIQGIRDKQSNKTILDYLIDDDFPHHRNRNFMQLINDDSLSFKKEIKKAQMITDTENLEEIVKELTGSPAIKKGILQSLKIVDEIVGIMGYEPANIVVEMARENQTTGRGLKSSRPRLKALEESLKDFGSQLLKEYPTDNSSLQKDRLYLYYLQNGRDMYTGAPLDIHRLSDYDIDHIIPRSFTTDNSIDNKVLVSSKENRLKKDDVPSEKVVKKMRSFWYDLYSSKLISKRKLDNLTKIKLTEEDKAGFIKRQLVETRQITKHVAGILHHRFNKAEDTNEPIRKVRIITLKSALVSQFRNRFGIYKVREINEYHHAHDAYLNGVIALALLKKYPQLAPEFVYGEYLKFNAHKANKATVKKEFYSNIMKFFESDTPVCDENGEIFWDKSKSIAQVKKVINHHHMNIVKKTEIQKGGFSKETVEPKKDSSKLLPRKNNWDPAKYGGLGSPNVAYTVAFTYEKGKARKRTNALEGITIMEREAFEQSPVLFLKNKGYEQAEIEMKLPKYALFELENGRKRMVASKEAQKANSFLLPEHLVTLLYHAKQYDEISHKESFDYVNEHHKEFSEVFARVLEFAGKYTLAEKNIEKLEKIYKENQTDDLAKLASSFVNLMQFNAMGAPADFKFFDVTIPRKRYTSLTEIWQSTIIHQSITGLYETRIRMGK

SEQ ID NO: 220 - protein, 1329 aa, Enterococcus faecium
MTKDYTIGLDIGTNSVGWAVLTDDYQLMKRKMSVHGNTEKKKIKKNFWGARLFDEGQTAEFRRTKRTNRRRLARRKYRLSKLQDLFAEELCKQDDCFFVRLEESFLVPEEKQYKPASIFPTLEEEKEYYQKYPTIYHLRQKLVDSTEKGDLRLVYLALAHLLKYRGHFLFEGDLDTENTSIEESFRVFLEQYGKQSDQPLIVHQPVLTILTDKLSKTKKVEEILKYYPTEKINSFFAQCLKLIVGNQANFKRIFDLEAEVKLQFSKETYEEDLESLLEKIGDEYLDIFLQAKKVHDAILLSEIISSTVKHTQAKLSSGMVERYERHKADLAKFKQFVKENVPQKATVFFKDTTKNGYAGYIKGKTTQEEFYKFVKKELSGVVGSEPFLEKIDQETFLLKQRTYTNGVIPHQVHLIELKAIIDQQKQHYPFLEEAGPKIIALFKFRIPYYVGPLAKEQEASSFAWIERKTAEKINPWNFSEVVDIEKSAMRFIQRMTKQDTYLPTEKVLPKNSLFYQKYMIFNELTKVSYKDERGVKQYFSGDEKQQIFKQLFQKERGKITVKKLQNFLYTHYHIENAQIFGIEKAFNASYSTYHDFMKLAKTNEWLEQPEMEPIFEDIVKILTIFEDRQMIKHQLSKYQEVFGEKLLKEFARKHYTGWGRFSAKLIHGIRDRKTNKTILDYLIDDDVPANRNRNLMQLINDEHLSFKEEIAKATVFSKHKSLVDVIQDLPGSPAIKKGIWQSLKIVEELIAIIGYKPKNIVIEMARENQKTHRTKPRLKALENGLKQIGSTLLKEQPTDNKALQKERLYLYYLQNGRDMYTGEPLEIENLHQYEVDHIIPRSFIVDNSIDNKVLVASKQNQKKRDDVPKKQIVNEQRIFWNQLKEAKLISPKKYAYLTKIELTPEDKARFIQRQLVETRQITKHVANILHQSFNQEEEGTDCDGVQIITLKATLTSQFRQTFGLYKVREINPHHHAHDAYLNGFIANVLLKRYPKLAPEFVYGKYVKYSLARENKATAKKEFYSNILKFLESDEPFCDENGEIYWEKSHHLPRIKKVLSSHQVNVVKKVEQQKGGFYKETVNSKEKPDKLIERKNNWDVTKYGGFGSPVIAYAIAFVYAKGKTQKKTKAIEGITIMEQAAFEKDPTTFLKDKGFPQVTEFIKLPKYTLFEFDNGRRRFLASKESQKGNPFILSDQLVTLLYHAQHYDKITYQESFDYVNTHLSDFSAILTEVLAFAEKYTLADKNIERIQELYEENKYGEISMIAQSFLQLLQFNAIGAPADFKFFGVTIPRKRYTSLTEIWDATIIYQSVTGLYETRIRMGDLWAGEQ

SEQ ID NO: 221 - protein, 1329 aa, Enterococcus faecium
MTKDYTIGLDIGTNSVGWAVLTDDYQLMKRKMSVHGNTEKKKIKKNFWGARLFDEGQTAEFRRTKRTNRRRLARRKYRLSKLQDLFAEELCKQDDCFFVRLEESFLVPEEKQYKPASIFPTLEEEKEYYQKYPTIYHLRQKLVDSTEKEDLRLVYLALAHLLKYRGHFLFEGDLDTENTSIEESFRVFLEQYSKQSDQPLIVHQPVLTILTDKLSKTKKVEEILKYYPTEKINSFFAQCLKLIVGNQANFKRIFDLEAEVKLQFSKETYEEDLESLLEKIGDEYLDIFLQAKKVHDAILLSEIISSTVKHTKAKLSSGMVERYERHKADLAKFKQFVKENVPQKATVFFKDTTKNGYAGYIKGKTTQEEFYKFVKKELSGVVGSEPFLEKIDQETFLLKQRTYTNGVIPHQVHLIELKAIIDQQKQHYPFLEEAGPKIIALFKFRIPYYVGPLAKEQEASSFAWIERKTAEKINPWNFSEVVDIEKSAMRFIQRMTKQDTYLPTEKVLPKNSLLYQKYMIFNELTKVSYKDERGVKQYFSGDEKQQIFKQLFQKERGKITVKKLQNFLYTHYHIENAQIFGIEKAFNASYSTYHDFMKLAKTNEWLEQPEMEPIFEDIVKILTIFEDRQMIKHQLSKYQEVFGEKLLKEFARKHYTGWGRFSAKLIHGIRDRKTNKTILDYLIDDDVPANRNRNLMQLINDEHLSFKEEIAKATVFSKHKSLVDVIQDLPGSPAIKKGIWQSLKIVEELIAIIGYKPKNIVIEMARENQKTHRTSPRLKALENGLKQIGSTLLKEQPTDNKALQKERLYLYYLQNGRDMYTGEPLEIENLHQYEVDHIIPRSFIVDNSIDNKVLVASKQNQKKRDDVPKKQIVNEQRIFWNQLKEAKLISPKKYAYLTKIELTPEDKARFIQRQLVETRQITKHVANILHQSFNQEEEGTDCDGVQIITLKATLTSQFRQTFGLYKVREINPHHHAHDAYLNGFIANVLLKRYPKLAPEFVYGKYVKYSLARENKATAKKEFYSNILKFLESDEPFCDENGEIYWEKSHHLPRIKKVLSSHQVNVVKKVEQQKGGFYKETVNSKEKPDKLIERKNNWDVTKYGGFGSPVIAYAIAFVYAKGKTQKKTRAIEGITIMEQAAFEKDPTTFLKEKGFPQVTEFIKLPKYTLFEFDNGRRRFLASKESQKGNPFILSDQLVTLLYHAQHYDKITYQESFDYVNTHLSDFSAILTEVLAFAEKYTLADKNIERIQELYEENKYGETSMIAQSFLQLLQFNAIGAPADFKFFGVTIPRKRYTSLTEIWDATIIYQSVTGLYETRIRMGDLWAGEQ

SEQ ID NO: 222 - protein, 1329 aa, Enterococcus faecium
MTKDYTIGLDIGTNSVGWAVLTDDYQLMKRKMSVHGNTEKKKIKKNFWGARLFDEGQTAEFRRTKRTNRRRLARRKYRLSKLQDLFAEELCKQDDCFFVRLEESFLVPEEKQYKPASIFPTLEEEKEYYQKYPTIYHLRQKLVDSTEKEDLRLVYLALAHLLKYRGHFLFEGDLDTENTSIEESFRVFLEQYGKQSDQPLIVHQPVLTILTDKLSKTKKVEEILKYYPTEKINSFFAQCLKLIVGNQANFKRIFDLEAEVKLQFSKETYEEDLESLLEKIGDEYLDIFLQAKKVHDAILLSEIISSTVKHTQAKLSSGMVERYERHKADLAKFKQFVKENVPQKATVFFKDTTKNGYAGYIKGKTTQEEFYKFVKKELSGVVGSEPFLEKIDQETFLLKQRTYTNGVIPHQVHLIELKAIIDQQKQHYPFLEEAGPKIIALFKFRIPYYVGPLAKEQEASSFAWIERKTAEKINPWNFSEVVDIEKSAMRFIQRMTKQDTYLPTEKVLPKNSLLYQKYMIFNELTKVSYKDERGVKQYFSGDEKQQIFKQLFQKERGKITVKKLQNFLYTHYHIENAQIFGIEKAFNASYSTYHDFMKLAKTNEWLEQPEMEPIFEDIVKILTIFEDRQMIKHQLSKYQEVFGEKLLKEFARKHYTGWGRFSAKLIHGIRDRKTNKTILDYLIDDDVPANRNRNLMQLINDEHLSFKEEIAKATVFSKHKSLVDVIQDLPGSPAIKKGIWQSLKIVEELIAIIGYKPKNIVIEMARENQKTHRTKPRLKALENGLKQIGSTLLKEQPTDNKALQKERLYLYYLQNGRDMYTGEPLEIENLHQYEVDHIIPRSFIVDNSIDNKVLVASKQNQKKRDDVPNKQIVNEQRIFWNQLKEAKLISPKKYAYLTKIELTPEDKARFIQRQLVETRQITKHVANILHQSFNQEEEGTDCDGVQIITLKATLTSQFRQTFGLYKVREINPHHHAHDAYLNGFIANVLLKRYPKLAPEFVYGKYVKYSLARENKATAKKEFYSNILKFLESDEPFCDENGEIYWEKSHHLPRIKKVLSSHQVNVVKKVEQQKGGFYKETVNSKEKPDKLIERKNNWDVTKYGGFGSPVIAYAIAFVYAKGKTQKKTRAIEGITIMEQAAFEKDPTTFLKDKGFPHVTEFIKLPKYTLFEFDNGRRRFLASKESQKGNPFILSDQLVTLLYHAQHYDKITYQESFDYVNTHLSDFSAILTEVLAFAEKYTLADKNIERIQELYEENKYGEISMIAQSFLQLLQFNAIGAPADFKFFGVTIPRKRYTSLTEIWDATIIYQSVTGLYETRIRMGDLWAGEQ

SEQ ID NO: 223 - protein, 1324 aa, Enterococcus italicus
MKNDYTIGLDIGTNSVGYSVVTDDYKVISKKMNVFGNTEKKSIKKNFWGVRLFESGQTAQEARMKRTSRRRIARRKNRICYLQEIFQPEMNHLDNNFFYRLNESFLVADDAKYDKHPIFGTLDEEIHFHEQFPTIYHLRKYLADGDEKADLRLVYLAIAHIIKFRGNFLIEGELNTENNSVIELSKVFVQLYNQTLSELEFIDESIDFSEVLTQQLSKSERADNVLKLFPDEKGTGIFAQFIKLIVGNQGNFKKVFQLEEDQKLQLSTDDYEENIENLLAIIGDEYGDIFVAAQNLYQAILLAGILTSTEKTRAKLSASMIQRYEEHAKDLKLLKRFVKEHIPDKYAEIFNDATKNGYAGYIDGKTKEEEFYKYLKTTLVQKSGYQYFIEKIEQENFLRKQRIYDNGVIPHQVHAEELRAILRKQEKYYSFLKENHEKIEQIFKVRIPYYVGPLAKHNEQSRFAWNIRKSDEPIRPWNMNDVVDENASAVAFIERMTIKDIYLNENVLPRHSLIYEKFTVFNELTKVLYADDRGVFQRFSAEEKEDIFEKLFKSERKVTKKKLENYLRIELSISSPSVKGIEEQFNANFGTYLDLKKFDELHPYLDDEKYQDTLEEVIKVLTVFEDRSMIQNQLEQLPLNLSTKTIKALSRRKYTGWGRLSARLIDGIHDKNSGKTILDYLIDESDSYIVNRNFMQLINDDHLSFKKIIEDSQPYKEQQSAEEIVSELSGSPAIKKGILQSLKIVDELVAIMGYKPKNIVVEMARENQTTGRGKQNSKPRLKGIENGLKEFSDSVLKGSSIDNKQLQNDRLYLYYLQNGKDMYTGHELDIDHLSTYDIDHIIPQSFLTDNSIDNRVLTTSKSNRGKSDNVPSEEVVRKMDRFWRKLLNAKLISERKYTNLTKKELTESDKAGFLKRQLVETRQITKHVATILDSKFNEDSNNRDVQIITLKSALVSEFRKTFNLYKVREINDLHHAHDAYLNAVVALSLLRVYPQLKPEFVYGEYGKNSIHDQNKATIKKQFYSNITRYFASKDIINDDGEILWNKQETIAQVIKTLGMHQVNVVKKVEIQKGGFSKESIQPKGESQKLIRRKQQWNTKKYGGFDSPVVAYAILLSFDKGKRKARSFKIVGITIQDRESFEGNPILYLSKKDYHNPKVEAILPKYSLFEFENGRRRMVASSETQKGNQLIIPGHLMELLYHSKKIINGKNSDSVSYIQNNKEKFREIFEYIVDFSSKYISADANLNKIEKIFENNFHKASEQEIAKSFINLLTFTAMGAPADFEFFGEKIPRKRYVSISEIIDAVFIHQSITGLYETRVRLTEV

SEQ ID NO: 224 - protein, 1323 aa, Enterococcus mundtii
MEKEYTIGLDIGTNSVGWAVLTDDYRLVARKMSIQGDSNRKKIKKNFWGARLFEEGKTAQFRRIKRTNRRRIARRRQRVLALQDIFAEEIHKKDPNFFARLEEGDRVEADKRFAKFPVFATLSEEKNYHRQYPTIYHLRHDLANSKEQADIRLVYLAIAHCLKYRGHFLFEGELDTENTSVTENYQQFLQAYQQFFPEPIGDLDDAVPILTERLSKAKRVEKVLAYYPSEKSTGNFAQFLKLMVGNQANFKKTFDLEEEMKLNFTRDCYEEDLNELLEKTSDDYAELFLKAKGVYDAILLSQILSKSDDETKAKLSANMKLRFEEHQRDLKQLKELVRRDLPKKYDDFFKNRSKNGYAGYVKGKATQEDFYKFLRTELAGLEESQSIMEKIDLEIYLLKQRTFANGVIPHQIHLVEMREIMDRQKRFYPFLKGAQGKIEKLLTFRIPYYVGPLAQEGQSPFAWIKRKSPSQITPWNFAEVVDKENSAIEFIERMTNQDTYLPKEKVLPKQSLIYQRFMIFNELTKVSYTDERGKSHYFSSEQKRKIFNELFKQHPRVTEKQLRKFLELNEQIDSTEIKGIETSFNASYSTYHDLLKLSTLLDDPDMTTMFEEIIKILTIFEDREMIREQLKPYETVLGLPAIKKLAKKHYTGWGRLSEKMIQGMREKQSRKTILDYLIDDDFPCNRNRNFMQLINDDHLSFKETIANELIMSDSNVLLDQVKAIPGSPAVKKGIWQSIKIVEEIIGIIGKAPKNIVIEMARENQRTSRSRPRLKALEEALKNIDSPLLKDYPTDNQALQKDRLYLYYLQNGKDMYTGEPLEIHRLSEYDIDHIIPRSFIVDNSLDNKVLVSSKVNRGKLDNAPDPLVVKRMRSHWEKLHQAKLISDKKLANLTKQNLTEADKARFIQRQLVETRQITKHVANLLHQHFNLPEEVSATEKTSIITLKSTLTSQFRQMFDIYKVREINHHHHAHDAYLNGVVAMTLLKKYPKLAPEFVYGSYIKGDINQINKATAKKEFYSNIMKFFESEEIICDEQGEVIWNKKRDLSTIKKTIGAHQVNIVKKVEKQKGGFYKETINSKANPEKLIPRKASLDPLKYGGYGSPLVAYTVIFIFEKGKQKKVTKGIEGITVMEQLRFEQDPREFLKTKGYEGVKQWLILPKYILFEAQGGYRRMIASQETQKANSLILPENLVTLLYHARHYDEINHKVSFDYVNAHKEGFNDIFDFISDFGVRYILAPQHLEKIKVAYEKNKEVDLKEMIDAILSLLKFTLFGASVEFKFFDIKILKRYKSLTDIWEATIIYQSVTGLYERRVEVRKLWDGER

SEQ ID NO: 225 - protein, 1330 aa, Enterococcus phoeniculicola
MKKEYTIGLDIGTNSVGWAVLTENYDLVKKKMKVYGNTETKYLKKNLWGVRLFDEGETAADRRLKRTTRRRYSRRRNRICRLQDLFTEEMNQVDANFFHRLQESFLVPDEKEFERHAIFGKMEEEVSYYREFPTIYHLRKHLADTSEQADLRLVYLALAHIVKYRGHFLIEGELNTENSSVSETFRTFIQVYNQIFRENEPLAVPDNIEELFSEKVSRARKVEAILSVYSEEKSTGTLAQFLKLMVGNQGRFKKTFDLEEDGIIQIPKEEYEEELETLLAIIGDEYAEIFSATKSVYDAVALSGILSVTDGDTKAKLSASMVERYEAHQKDLVQFKQFIRKELPEMYAPIFRDNSVSGYAGYVENSVTQAEFYKYIKKAIEKVPGAEYFLEKIEQETFLDKQRTFNNGVIPHQIHLEELEAIIQKQATYYPFLADNKEEMKQLVTFRIPYYVGPLADGNSPFAWLERISSEPIRPGNLAEVVDIKKSATKFIERMTNFDTYLPTEKVLPKHSMIYEKYMVYNELTKVSYVDERGMNQRFSGEEKKQIVEELFKQSRKVTKKLLEKFLSNEFGLVDVAIKGIETSFNAGYGTYHDFLKIGITREQLDKEENSETLEEIVKILTVFEDRKMIREQLKKYTYLFDEEVLKKLERRHYTGWGRLSAKLLIGIKEKRTHKTILDYLIDDGGKQPINRNLMQLINDSDLSFKSEIAEAQSDMNTEDLHEVVQNLAGSPAIKKGILQSLKIVDELVDIMGSLPKNIVVEMARENQTTSRGRTNSNPRMKALEEAMRNLRSNLLKEYPTDNQALQNDRLYLYYLQNGKDMYTGLDLSLHNLSSYDIDHIVPQSFTTDNSLDNRVLVSSKENRGKKDDVPSKEVVQKNITLWETLKNSNLISQKKYDNLTKGLRGGLTEDDRAHFIKRQLVETRQITKHVARILDQRFNSQKDEEGKTIRAVRVVTLKSSLTSQFRKQFAIHKVREINDYHHGHDAYLNGVVANSLLRVYPQLQPEFVYGDYPKFNAYKANKATAKKQLYTNIMKFFAEDAVIIDENGEILWDKKNIATVKKVMSYPQMNIVKKPEIQTGSFSKETIKPKGDSDKLISRKTNWSPKLYGGFDSPQVAYSVIITYEKGKKKVRAKAIVGITIMEQSLFKKDPVSLLEEKGYANPEVLIHLPKYTLYELENGRRRLLASANEAQKGNQLVLPASLVTLLYHAKQVDEDSGKSEEYVREHRAEFAEILNYVQAFSETKILANKNLQTILKLYEENKEADIKEIAESFVNLMKFSAYGAPMDFKFFGKTIPRSRYTSVGELLSATIINQSITGLYETRRKLVD

SEQ ID NO: 226 - protein, 1327 aa, Enterococcus sp. AM1
MGKEYTIGLDIGTNSVGWAVLQEDLDLVRRKMKVYGNTEKNYLKKNFWGVDLFDEGMTAKDTRLKRTTRRRYFRRRQRISYLQTFFQEEMNRIDPNFFNRLDESFLIEEDKLSERHPIFGTIEEEVAYHKNYATIYHLRKELADAEEKADLRLVYLALAHIIKYRGHFLIEGRLSTENTSTEETFKTFLQKYNQTFNPVDETISIGSIFADKVSRAKKAEGVLALFPDEKRNGTFDQFLKMIVGNQGNFKKTFELEEDAKLQFSKEEYDESLEALLGEIGDEYADVFEAAKNVYNAVELSGILTVTDNSTKAKLSASMIKRYEDHKTDLKLFKEFIRKNLPEKYHEIFNDKNTDGYAGYIDNSTSQEKFYKYITNLIEKIDGAEYFLKKIENEDFLRKQRTFDNGIIPHQIHLEELKAILHHQAMYYPFLQEKFSNFVDLLTFRIPYYVGPLANGNSRFSWLSRKSDEPIRPWNLAEVVDLSKSAELFIERMTNFDLYLPSEKVLPKHSMLYEKYTVYNELTKVTYKDEQGKVQNFSSEEKERIFIDLFKQHRKVTKKDLSNFLRNEYNLDDVIIDGIENKFNASFNTYHDFLKLKIDPKVLDDPANEPMFEEIVKILTIFEDRKMLREQLSKFSDRLSEKTIKDLERRHYTGWGRLSAKLINGIHDKQSNKTILDYLIDDAPKKNINRNFMQLINDNRLTFKEEIEKEQLKANSEESLIEIVQNLAGSPAIKKGIFQSLKIVDELVEIMGYAPTNIVVEMARENQTTANGRRNSRPRLKNLEKAIDDLDSEILKKHPVDNKALQKDRLYLYYLQNGKDMYTNEELDIHKLSTYDIDHIIPQSFIVDNSLDNRVLVSSSKNRGKLDDVPSKEVVKKMRAFWESLYRSGLISKKKFDNLVKAESGGLSEDDKAGFIHRQLVETRQITKNVARILHQRFNSEKDEEGNLIRKVRIITLKSALTSQFRKNYGIYKIREINDYHHAHDAYLNGVVATALLKIYPQLEPEFVYGEFHRFNAFKENKATAKKQFYSNLMEFSKSDKVIIDENGEILWNQKKIVTVKKVMNYRQMNIVKKVEIQKGGFSKESILPKGDSDKLISRKKEWDTTKYGGFDSPNVAYSVVIRYEKGKTRKLVKTIVGITIMERAAFEKNEREFLKNKGYQNPQICMKLPKYSLYEFDDGRRRLLASAKEAQKGNQMVLPAHLVTFLYHAKHCNEKPDSLKYVTEHQSGFSEIMAHVKDFAEKYTLVDKNLEKILSLYAKNMDSEVKEIAQSFVDLMQLNAFGAPADFKFFGETIPRKRYTSVNELLEATIINQSITGLYETRRRLGD

SEQ ID NO: 227 - protein, 1332 aa, Enterococcus villorum
MNKAYTLGLDIGTNSVGWAVVTDDYRLMAKKMPVHSKMEKKKIKKNFWGARLFDEGQTAEERRNKRATRRRLRRRKYRILELQKIFSEEILKKDSHFFARLDESFLIPEDKQYARFPIFPTLLEEKAYYQNYPTIYHLRQKLADSTEKADIRLVYLALAHMIKYRGHFLFEGELDTENTSVEETFKEFIDIYNEQFEEGIIFYKDIPLILTDKLSKSKKVEKILQYYPKEKTTGCLAQFLKLIVGNQGNFKQAFHLDEEVKIQISKETYEEDLEKLLRKSNEEMIDVFLQVKKVYDAILLSDILSTKMKDTKAKLSAGMIERYQNHKKDLEELKQFVRAHLHEKVTVFFKDSSKDGYAGYIDGKTTQADFYKFLKKELTGVPGSEPMLAKIDQENFLLKQRTPTNGVIPHQVHLTEFKAIIDQQKQYYPFLEKSKEKMIQLLTFRIPYYVGPLAQDKETSSFAWLERKTTEKIKPWNAKDVIDYGASATKFIQRMINYDTYLPTEKVLPKYSMLYQKYTIFNELTKVAYKDDRGIKHQFSSEEKLRIFQELFKKQRRVTKKKLQHFLSANYNIEDAEILGVDKVFNSSYATYHDFLELAKPYELLEQPEMEEMFEDIVKIITIFEDREMVRTQLKKYQRILGEEIFKKLVKKKYTGWGRLSKRLINGIRDQKTNKTILDYLIDDDFPYNRNRNFMQLINDDHLSFKEEIAKELTLSDKQSLLEVVEAIPGSPAIKKGIWQTLKIVEELIAIIGYKPKNIVIEMARENQTTTGGKNRSKPRLKSLEEALKNFDSQLLKERPVDNQSLQKDRLYLYYLQNGKDMYTGESLDIDRLSEYDIDHIIPRSFIVDHSLDNKVLVSSKENRLKKDDVPDSKVVKRMKAYWEKLLRANLISERKFSYLTKLELTDDDKARFIQRQLVETRQITKHVAAILHQYFNQTQELEKEKDIRIITLKSSLVSQFRQVFGIHKVREINHHHHAHDAYLNAVVALALLKKYPRLAPEFVYGSFAKFHLVKENKATAKKEFYSNILKFFEKEEQFCDENGEIFWDKRKHIQQIKKVISSHQVNIVKKVEVQTGSFYKETVNTKEKPDKLIKRKNNWDVTKYGGFGSPVVAYAVVFTYEKGKNHKKAKAIEGITIMEQALFEKDPISFLIEKGYSNVNQFIKLPKYTLFELANGQRRMLASQELQKANSFILPEKLVTLLYHANHYDEIAYKDSYDYVNEHFSNFQDILDKVIIFAEKYTSAPQKLNQIIATYEKNQEADRKIMAHSFVNLMQFNALGAPADFKFFDTTITRKRYTSLTEIWQSTIIYQSVTGLYETRRRMADLWDGVQ

SEQ ID NO: 228 - protein, 1359 aa, Artificial Sequence
  Synthetic Polypeptide
ADKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 229 - protein, 1300 aa, Kandleria vitulina
NNKIYNIGLDIGDASVGWAVVDEHYNLLKRHGKHMWGSRLFTQANTAVERRSSRSTRRRYNKRRERIRLLRGIMEDMVLDVDPTFFIRLANVSFLDQEDKKDYLKSNYNLFIDKDFNDKTYYDKYPTIYHLRKHLCESKEKEDPRLIYLALHHIVKYRGNFLYEGQKFSMDVSNIEDKMIDVLRQFNEINLFEYVEDKKIDEVLNVLKEPLSKKHKADKAFALFDTTKDNKAAYKELCAALAGNKFNVTKMLKEAELHDEDEKDISFKFSDATFDDAFVEKQPLLGDCVEFIDLLHDIYSWVELQNILGSAHTSEPSISAAMIQRYEDHKNDLKLLKDVIRKYLPKKYFEVFRDEKSKKNNYCNYINHKTPVDEFYKYIKKLIEKIDDPDVKTILNKIELESFMLKQNSRTNGAVPYQMQLDELNKILENQSVYYSDLKDNEDKIRSILTFRIPYYFGPLITKDRQFDWIIKKEGKENERILPWNANEIVDVDKTADEFIKRMRNFCTYFPDEPVLAKNSLTVSKYEVLNEINKLRINDHLIKRDIKDKMLHTLFMDHKSISANAMKKWLVKNQYFSNTDDIKIEGFQKENACSTSLTPWIDFTKIFGEINNSNYELIEKIIYDVTVFEDKKILRRRLKKEYDLDEEKIKKILKLKYSGWSRLSKKLLSGIKTKRTPETVLEVMETNMNLMQVINDEKLGFKKTIDDANSTSVSGKFSYAEVQELAGSPAIKRGIWQALLIVDEIKKIMKHEPAHVYIEFARNEDKERKDSFVNQMLKLYKDFEDEANKHLKGEDAKSKIRSERLKLYYTQMGKCMYTGKSLDIDRLDTYQVDHIVPQSLLKDDSIDNKVLVLSSENQRKLDDLVIPEMIRNKMFGFWNKLYENKIISPKKFYSLIKSEYSDKDKERFINRQIVETRQITKHVAQIISNHYETTKVVTVRADLSHAFRERYHIYKNRDINDFHHAHDAYIATILGTYIGHRFESLDAKYIYGEYQKIFRNKNKDKKDGFILNSMRNLYADKDTGEVVWDPEWISRIKKCFYYKDCFVTKKLEENNGSFFNTVRPNDEHSEKGAKVPVNKLRSNVHKYGGFEGLKYSIVAIKGKKKKGKKIIDVNKLVGIPLMYKNVDDETKINYIKESEGLEEVKIIKEILKNQLIEINGGLFYVTSEIVNARQLILDFNCTRIIDGIYKAMKYKNYSELSQEEIMNVYDIFVEKLKLYYPTYKNIATNFENFENISDEEKCEVIQMLVVMHAGPQNGNITFDDFKLSNRLGRLNCKTISLTTVFIADSPTGMYSKKYKL

SEQ ID NO: 230 - protein, 1301 aa, Kandleria vitulina
NNKIYNIGLDIGDASVGWAVVDEHYNLLKRHGKHMWGSRLFTQANTAVERRSSRSTRRRYNKRRERIRLLREIMEDMVLDVDPTFFIRLANVSFLDQEDKKDYLKSNYNLFIDKDFNDKTYYDKYPTIYHLRKHLCESKEKEDPRLIYLALHHIVKYRGNFLYEGQKFSMDVSNIEDKMIDVLRQFNEINLFEYVEDKKIDEVLNVLKEPLSKKHKAEKAFALFDTTKDNKAAYKELCAALAGNKFNVTKMLKEAELHDEDEKDISFKFSDATFDDAFVEKQPLLGDCVEFIDLLHDIYSWVELQNILGSAHTSEPSISAAMIQRYEDHKNDLKLLKDVIRKYLPKKYFEVFRDEKSKKNNYCNYINHKTPVDEFYKYIKKLIEKIDDPDVKTILNKIELESFMLKQNSRTNGAVPYQMQLDELNKILENQSVYYSDLKDNEDKIRSILTFRIPYYFGPLITKDRQFDWIIKKEGKENERILPWNANEIVDVDKTADEFIKRMRNFCTYFPDEPVMAKNSLTVSKYEVLNEINKLRINDHLIKRDMKDKMLHTLFMDHKSISANAMKKWLVKNQYFSNTDDIKIEGFQKENACSTSLTPWIDFTKIFGKINESNYDFIEKIIYDVTVFEDKKILRRRLKKEYDLDEEKIKKILKLKYSGWSRLSKKLLSGIKTKRTPETVLEVMETNMNLMQVINDEKLGFKKTIDDANSTSVSGKFSYAEVQELAGSPAIKRGIWQALLIVDEIKKIMKHEPAHVYIEFARNEDKERKDSFVNQMLKLYKDFEDEANKHLKGEDAKSKIRSERLKLYYTQMGKCMYTGKSLDIDRLDTYQVDHIVPQSLLKDDSIDNKVLVLSSENQRKLDDLVIPSSIRNKMYGFWEKLFNNKIISPKKFYSLIKTEFNEKDQERFINRQIVETRQITKHVAQIIDNHYENTKVVTVRADLSHQFRERYHIYKNRDINDFHHAHDAYIATILGTYIGHRFESLDAKYIYGEYKRIFRQKNKGKNDGFILNSMRNIYADKDTGEIVWDPNYIDRIKKCFYYKDCFVTKKLEENNGTFFNTVLPNDTNSDKDATVPVNKYRSNVNKYGGFSGVNSFIVAIKGKKKKGKKVIEVNKLTGIPLMYKNADEEIKINYLKQAEDLEEVQIGKEILKNQLIEKDGGLYYIVAEIINAKQLILNESQTKLVCEIYKAMKYKNYDNLDSEKIIDLYRLLINKMELYYPEYRKQLVKKFEDLKVISIEEKCNIIQILATLHCNSSIGKIMYSDFKISTTIGRLNGRTISLDISFIAESPTGMYSKKYKL

SEQ ID NO: 231 - protein, 1304 aa, Lactobacillus animalis
LKKDYSIGLDIGTNSVGHAVVTDDYKVPTKKMKVFGDTSKKTIKKNMLGVLLFNEGQTAADTRLKRGARRRYTRRKNRLRYLQEIFAPALAKVDPNFFYRLEESSLVAEDKKYDVYPIFGKREEELLYHDTHKTIYHLRSELANNDRPADLRLVYLALAHIIKYRGNFLLEGEIDLRTTDINKVFAEFSETLNENSDENLGKLDVADIFKDNTFSKTKKSEELLKLSGKKNQLAHQLFKMMVGNMGSFKKVLGTDEEHKLSFGKDTYEDDLNDLLAEAGDQYLDIFVAAKKVYDAAILASILDVKDTQTKTVFSQAMIERYEEHQKDLIELKRVFKKYLPEKCHDFFSEPKISGYAGYIDGKVSEEDFYKYTKKTLKGIPETEEILQKIDANNYLRKQRTFDNGAIPHQVHLKELVAIVENQGKYYPFLRENKDKFEKILNFRIPYYVGPLARGNSKFAWLTRAGEGKITPYNFDEMIDKETSAEDFIKRMTINDLYLPTEPVLPKHSLLYERYTIFNELAGVRYVTENGEAKYFDAQTKRSIFELFKLDRKVSEKMVIKHLKVVMPAIRIQALKGLDNGKFNASYGTYKDLVDMGVAPELLNDEVNSEKWEDIIKTLTIFEGRKLIKRRLENYRDFLGEDILRKLSRKKYTGWGRLSAKLLDGIYDKKTHKTILDCLMEDYSQNFMQLINDDTYSFKETIKNAQVIEKEETLAKTVQELPGSPAIKKGILQSLEIVDEIIKVMGYKPKSIVVEMARETQTHGTRKREDRVQQIVKNLKELPKPSNAELSDERKYLYCLQNGRDMYTGAPLDYDHLQFYDVDHIIPQSFLKDDSIENKVLTIKKENVRKTNGLPSEAVIQKMGSFWKKLLDAGAMTNKKYDNLRRNLHGGLNEKLKERFIERQLVETRQITKYVAQLLDQRLNYDGNGVELDEKIAIVTLKAQLASQFRSEFKLRKVRALNNLHHAHDAYLNAVVANLIMAKYPELEPEFVYGKYRKTKFKGLGKATAKNTLYANVLYFLKENEVYPFWDKARDLPTIKRYLYRAQVNKVRKAERQTGGFSDEMLVPKSDSGKLLPRKEGLDPVKYGGYAKAVESYAVLITADEVKKGKTKKVKTLVNIPIIDSKKYEADPTAYLASRGYTNVTNSFILPKYSLLEDPEGRRRYLASKEFQKANELILPQHLVELLYWVNAKDGEQKLEDHKAEFKELFDKIMEFADKYVVAPKNSEKIRRLYEENQDATPMELGKNFVELLRYTADGAASDFKFFGENIPRKRYNSAGSLLNGTLIYQSKTGLYETRIDLGKL

SEQ ID NO: 232 - protein, 1292 aa, Lactobacillus curvatus
MSRPYNIGLDIGTSSIGWSVVDDQSKLVSVRGKYGYGVRLYDEGQTAAERRSFRTTRRRLKRRKWRLGLLREIFEPYITPVDDTFFLRKKQSNLSPKDQRKQTSLFNDRTDRAFYDDYPTIYHLRYKLMTEKRQFDIREIYLAMHHIVKYRGHFLNEAPVSSFKSSEINLVAHFDRLNTIFADLFSESGFTDKLAEVKALLLDNHQSASNRQRQALLLIYTPSKQNKAIATELLKAILGLKAKFNVLTGIEAEDVKTWTLTFNAENFDEEMVKLESSLDDNAHQIIESLQELYSGVLLAGIVPENQSLSQAMITKYDDHQKHLKMLKAVREALAPEDRQRLKQAYDQYVDGKSKEDFYGDITKALKNNPDHPIVSEIKKLIELDQFMPKQRTKDNGAIPHQLHQQELDRIIENQQQYYPWLAELNPNKLDELVAFRVPYYVGPLQQQSSDAKFAWMIRKAEGQITPWNFDDKVDRQASANEFIKRMTTTDTYLLAEDVLPKQSLIYQRFEVLNELNGLKIDDQPITTELKQAIFTDLFMQKTSVTVKNIQDYLVSEKRYASRPAITGLSDENKFNSRLSTYHDLKTIVGDAVDDVDKQADLEKCIEWSTIFEDGKIYSAKLNEIDWLTDQQRVQLAAKRYRGWGRLSAKLLTQIVNANGQRIMDLLWTTDNFMRIVHSEDFDKLITEANQMMLAENDVQDVINDLYTSPQNKKALRQILLVVNDIQKAMKGQAPERILIEFAREDEVNPRLSVQRKRQVEQVYQNISELEIRNELKDLSNSALSNTRLFLYFMQGGRDMYTGDSLNIDRLSTYDIDHILPQSFIKDNSLDNRVLVSQRMNRSKADQVPSVELGQKMQIQWEQMLRAGLITKKKYDNLTLNPDMKGFINRQLVETRQVIKLATNLLMEQYGEDNIELITVKSGLTHQMRTEFDFPKNRNLNNHHHAFDAYLTAFVGLYLLKRYPKLKPYFVYGEYQKASQQDKRNFNFLNGLKKDELVDENTEAVIWNKESGLAYLNKIYQFKKILVTREVHENSGALFNQTLYAAKDDKASGQLIPAKQDRPTALYGGYSGKTVAYMCIVRIKNKKGDLYKVCGVETSWLAQLKQKKAFLKQKISPQFTKVKKQKGTIVKVVEDFEVIAPHILINQRFFDNGQELTLGSHNEQELILDKTAVKLLNGALPLTQSEELAEQVYDEILDQVMHYFPLYDTNQFRAKLSAGKAADGNKMVQVGQQVILDRVLIGLHANAAVSDLGVLKISTPLGKMQQPSGISDTQIIYQSPTGLFERRVALRDL

SEQ ID NO: 233 - protein, 1291 aa, Lactobacillus farciminis
KEQPYNIGLDIGTGSVGWAVTNDNYDLLNIKKKNLWGVRLFEGAQTAKETRLNRSTRRRYRRRKNRINWLNEIFSEELANTDPSFLIRLQNSWVSKKDPDRKRDKYNLFIDNPYTDKEYYREFPTIFHLRKELIINKNKADIRLVYLALHNILKYRGNFTYEHQKFNISTLNSNLSKELIELNQQLIKYDISFPDNCDWNHISDILIGRGNATQKSSNILNNFTKETKKLLKEVINLILGNVAHLNTIFKTSLTKDEEKLSFSGKDIESKLDDLDSILDDDQFTVLDTANRIYSTITLNEILNGESYFSMAKVNQYENHAIDLCKLRDMWHTTKNEKAVGLSRQAYDDYINKKKELYTSLKKFLKVALPTNLAKEAEEKISKGTYLVKPRNSENGVVPYQLNKIEMEKIIDNQSQYYPFLKENKEKLLSILSFRIPYYVGPLQSSEKNPFAWMERKSNGHARPWNFDEIVDREKSSNKFIRRMTVTDSYLVGEPVLPKNSLIYQRYEVLNELNNIRITENLKTNPTGSRLTVETKQHIYNELFKNYKKITVKKLTKWLIAQGYYKNPILIGLSQKDEFNSTLTTYLDMKKIFGSSFMENNKNYNQIEELIEWLTIFEDKQILNEKLHSSNYSYTSDQIKKISNMRYKGWGRLSKKILTCITTETNTPKSLQLSNDLMWTTNNNFISIISNDKYDFKNYIENHNLNKNEDQNISNLVNDIHVSPALKRGITQSIKIVQEIVKFMGHAPKYIFIEVTRETKTTSRGKRIQRLQSKLLNKANGLVPEELKKHKNDLSSERIMLYFLQNGKSLYSEESLNINKLSDYQVDHILPRTYIPDDSLENKALVLAKENQRKADDLLLNSNVIDKNLERWTYMLNNNMMGLKKFKNLTRRVITDKDKLGFIHRQLVQTSQMVKGVANILNSMYKNQGTTCIQARANLSTAFRKALELVKNRNINDFHHAQDAYLASFLGTYRLRRFPTDEMLLMNGEYNKFYGKELYSKKSRKNGFIISPLVNGTTQDRNTGEIIWNVGFRDKILKIFNYHQCNVTRKTEIKTGQFYDQTIYSPKNPKKLIAQKKDMDPNIYGGFSGDNKSSITIVKIDNNKIKPVAIPIRLINDKKTLQNWLEENVKHKKSIQIIKNNVPIGQIIYSKKVGLLSREIANRQQLILPPEHSALLRILQIPDEDPDQILAFYDKNILVEILQELITKMKKFYPFYKNEQEFLASFNQATTSEKINSLEELITLLHANSTSAHLIFNNIEKKAFGRKTHGLTDTDFIYQSVTGLYETRIHIE

SEQ ID NO: 234 - protein, 1327 aa, Listeria innocua
MKKPYTIGLDIGTNSVGWAVLTDQYDLVKRKMKIAGDSEKKQIKKNFWGVRLFDEGQTAADRRMARTARRRIERRRNRISYLQGIFAEEMSKTDANFFCRLSDSFYVDNEKRNSRHPFFATIEEEVEYHKNYPTIYHLREELVNSSEKADLRLVYLALAHIIKYRGNFLIEGALDTQNTSVDGIYKQFIQTYNQVFASGIEKLEDNKDVAKILVEKVTRKEKLERILKLYPGEKSAGMFAQFISLIVGSKGNFQKPFDLIEKSDIECAKDSYEEDLESLLALIGDEYAELFVAAKNAYSAVVLSSIITVAETETNAKLSASMIERFDTHEEDLGELKAFIKLHLPKHYEEIFSNTEKHGYAGYIDGTKQADFYKYMKMTLENIEGADYFIAKIEKENFLRKQRTFDNGAIPHQLHLEELEAILHQQAKYYPFLKENYDKIKSLVTFRIPYFVGPLANGQSEFAWLTRKADGEIRPWNIEEKVDFGKSAVDFIEKMTNKDTYLPKENVLPKHSLCYQKYLVYNELTKVRYINDQGKTSYFSGQEKEQIFNDLFKQKRKVKKKDLELFLRNMSHVESPTIEGLEDSFNSSYSTYHDLLKVGIKQEILDNPVNTEMLENIVKILTVFEDKRMIKEQLQQFSDVLDGVVLKKLERRHYTGWGRLSAKLLMGIRDKQSHLTILDYLMDDGLNRNLMQLINDSNLSFKSIIEKEQVTTADKDIQSIVADLAGSPAIKKGILQSLKIVDELVSVMGYPPQTIVVEMARENQTTGKGKNNSRPRYKSLEKAIKEFGSQILKEHPTDNQELRNNRLYLYYLQNGKDMYTGQDLDIHNLSNYDIDHIVPQSFITDNSIDNLVLTSSAGNREKGDDVPPLEIVRKRKVFWEKLYQGNLMSKRKFDYLTKAERGGLTEADKARFIHRQLVETRQITKNVANILHQRFNYEKDDHGNTMKQVRIVTLKSALVSQFRKQFQLYKVRDVNDYHHAHDAYLNGVVANTLLKVYPQLEPEFVYGDYHQFDWFKANKATAKKQFYTNIMLFFAQKDRIIDENGEILWDKKYLDTVKKVMSYRQMNIVKKTEIQKGEFSKATIKPKGNSSKLIPRKTNWDPMKYGGLDSPNMAYAVVIEYAKGKNKLVFEKKIIRVTIMERKAFEKDEKAFLEEQGYRQPKVLAKLPKYTLYECEEGRRRMLASANEAQKGNQQVLPNHLVTLLHHAANCEVSDGKSLDYIESNREMFAELLAHVSEFAKRYTLAEANLNKINQLFEQNKEGDIKAIAQSFVDLMAFNAMGAPASFKFFETTIERKRYNNLKELLNSTIIYQSITGLYESRKRLDD

SEQ ID NO: 235 - protein, 1327 aa, Listeria innocua
MKKPYTIGLDIGTNSVGWAVLTDQYDLVKRKMKIAGDSEKKQIKKNFWGVRLFDEGQTAADRRMARTARRRIERRRNRISYLQGIFAEEMSKTDANFFCRLSDSFYVDNEKRNSRHPFFATIEEEVEYHKNYPTIYHLREELVNSSEKADLRLVYLALAHIIKYRGNFLIEGALDTQNTSVDGIYKQFIQTYNQVFASGIEKLEDNKDVAKILVEKVTRKEKLERILKLYPGEKSAGMFAQFISLIVGSKGNFQKPFDLIEKSDIECAKDSYEEDLESLLALIGDEYAELFVAAKNAYSAVVLSSIITVAETETNAKLSASMIERFDTHEEDLGELKAFIKLHLPKHYEEIFSNTEKHGYAGYIDGTKQADFYKYMKMTLENIEGADYFIAKIEKENFLRKQRTFDNGAIPHQLHLEELEAILHQQAKYYPFLKENYDKIKSLVTFRIPYFVGPLANGQSEFAWLTRKADGEIRPWNIEEKVDFGKSAVDFIEKMTNKDTYLPKENVLPKHSLCYQKYLVYNELTKVRYINDQGKTSYFSGQEKEQIFNDLFKQKRKVKKKDLELFLRNMSHVESPTIEGLEDSFNSSYSTYHDLLKVGIKQEILDNPVNTEMLENIVKILTVFEDKRMIKEQLQQFSDVLDGVVLKKLERRHYTGWGRLSAKLLMGIRDKQSHLTILDYLMDDGLNRNLMQLINDSNLSFKSIIEKEQVTTADKDIQSIVADLAGSPAIKKGILQSLKIVDELVSVMGYPPQTIVVEMARENQTTGKGKNNSRPRYKSLEKAIKEFGSQILKEHPTDNQELRNNRLYLYYLQNGKDMYTGQDLDIHNLSNYDIDHIVPQSFITDNSIDNLVLTSSAGNREKGDDVPPLEIVRKRKVFWEKLYQGNLMSKRKFDYLTKAERGGLTEADKARFIHRQLVETRQITKNVANILHQRFNYEKDDHGNTMKQVRIVTLKSALVSQFRKQFQLYKVRDVNDYHHAHDAYLNGVVANTLLKVYPQLEPEFVYGDYHQFDWFKANKATAKKQFYTNIMLFFAQKDRIIDENGEILWDKKYLDTVKKVMSYRQMNIVKKTEIQKGEFSKATIKPKGNSSKLISRKTNWDPMKYGGLDSPNMAYAVVIEYAKGKNKLVFEKKIIRVTIMERKAFEKDEKAFLEEQGYRQPKVLAKLPKYTLYECEEGRRRMLASANEAQKGNQQVLPNHLVTLLHHVANCEVSDGKSLDYIESNREMFAELLAHVSEFAKRYTLAEANLNKINQLFEQNKEGDIKAIAQSFVDLMAFNAMGAPASFKFFETTIERKRYNNLKELLNSTIIYQSITGLYESRKRLDD

SEQ ID NO: 236 - protein, 1327 aa, Listeria innocua; identical to SEQ ID NO: 235

SEQ ID NO: 237 - protein, 1101 aa, Listeria innocua
LKLYPGEKSTGMFAQFISLIVGSKGNFQKPFDLIEKSDIECAKDSYEEDLESLLALIGDEYAELFVAAKNAYSAVVLSSIITVAETETNAKLSASMIERFDTHEEDLGELKAFIKLHLPKHYEEIFSNTEKHGYAGYIDGTKQADFYKYMKTTLENIEGADYFIAKIEKENFLRKQRTFDNGAIPHQLHLEELEAILHQQAKYYPFLKENYDKIKSLVTFRIPYFVGPLANGQSEFAWLTRKADGEIRPWNIEEKVDFGKSAVDFIEKMTNKDTYLPKENVLPKHSLCYQKYLVYNELTKVRYINDQGKTSYFSGQEKEQIFNDLFKQKRKVKKKDLELFLRNMSHVESPTIEGLEDSFNSSYSTYHDLLKVGIKQEILDNPVNTEMLENIVKILTVFEDKRMIKEQLQQFSDVLDGVVLKKLERRHYTGWGRLSAKLLMGIRDKQSHLTILDYLMDDGLNRNLMQLINDSNLSFKSIIEKEQVTTADKDIQSIVADLAGSPAIKKGILQSLKIVDELVSVMGYPPQTIVVEMARENQTTGKGKNNSRPRYKSLEKAIKEFGSQILKEHPTDNQELKNNRLYLYYLQNGKDMYTGQDLDIHNLSNYDIDHIVPQSFITDNSIDNLVLTSSAGNREKGNDVPPLEIVQKRKVFWEKLYQGNLMSKRKFDYLTKAERGGLTEADKARFIHRQLVETRQITKNVANILHQRFNYGKDDHGNTMKQVRIVTLKSALVSQFRKQFQLYKVRGVNDYHHAHDAYLNGVVANTLLKVYPQLEPEFVYGDYHQFDWFKANKATAKKQFYTNIMLFFAQKDRIIDENGEILWDKKYLDTVKKVMSYRQMNIVKKTEIQKGEFSKATIKPKGNSSKLIPRKTNWDPMKYGGLDSPNMAYAVVIEYAKGKNKLVFEKKIIRVTIMERKAFEKDEKAFLEEQGYRQPKVLAKLPKYTLYECEEGRRRMLASANEAQKGNQQVLPNHLVTLLHHAANCEVSDGKSLDYIESNREMFAELLAHVSEFAKRYTLAEANLNKINQLFEQNKEGDIKAIAQSFVDLMAFNAMGAPASFKFFETTIERKRYNNLKELLNSTIIYQSITGLYESRKRLDD

SEQ ID NO: 238 - protein, 1327 aa, Listeria ivanovii
MRKPYTIGLDIGTNSVGWAVLTDQYNLVKRKMKVAGSAEKKQIKKNFWGVRLFDEGEVAAGRRMNRTTRRRIERRRNRIAYLQEIFAAEMAEVDANFFYRLEDSFYIESEKRHSRHPFFATIEEEVAYHEEYKTIYHLREKLVNSSDKADLRLVYLALAHIIKYRGNFLIEGMLDTKNTSVDEVFKQFIQTYNQIFASDIERLEENKEVAEILSEKLTRREKLDKILKLYTGEKSTGMFARFINLIIGSKGDFKKVFDLDEKAEIECAKDTYEEDLEALLAKIGDEYAEIFVAAKSTYNAVVLSNIITVTDTETKAKLSASMIERFDKHAKDLKRLKAFFKMQLPEKFNEVFNDIEKDGYAGYIDGTTQEKFYKYMKKMLANIDGADYFIDQIEEENFLRKQRTFDNGTIPHQLHLEELEAILHQQAKYYPFLRKDYEKIRSLVTFRIPYFIGPLANGQSDFAWLTRKADGEIRPWNIEEKVDFGKSAIDFIEKMTNKDTYLPKENVLPKHSLCYQKYMVYNELTKIRYIDDQGKTHHFSGQEKQQIFNGLFKQQRKVKKKDLERFLYTINHIESPTIEGVEDAFNSSFATYHDLQKGGVTQEILDNPLNADMLEEIVKILTVFEDKRMIKEQLQSFSDVLDGTILKKLERRHYTGWGRLSAKLLTGIRDKHSHLTILDYLMDDGLNRNLMQLINDSNLSFKSIIEKEQVSTADKGIQSIVAELAGSPAIKKGILQSLKIVDELVGIMGYPPQTIVVEMARENQTTGKGKNNSKPRFISLEKAIKEFGSQILKEHPTDNQCLKNDRLYLYYLQNGKDMYTGKELDIHNLSNYDIDHIIPQSFITDNSIDNRVLVSSTANREKGDNVPLLEVVRKRKAFWEKLYQAKLMSKRKFDYLTKAERGGLTEADKANFIQRQLVETRQITKNVANILYQRFNCKQDENGNEVEQVRIVTLKSTLVSQFRKQFQLYKVREVNDYHHAHDAYLNGVVANTLLKVYPQLEPEFVYGDYHQFDWFKANKATAKKQFYTNIMRFFAKENQIIDKNGEILWDNRYLDTIKKVLSYRQMNIVKKTEIQKGEFSNATVNPKGNSSKLISRKADWNPIKYGGFDGSNMAYSIVIEYEKRKKKTVIKKELIQINIMERVAFEKDQKAFLEEKGYYSPKVLTKIPKYTLYECENGRRRMLGSANEAQKGNQMVLPNHLMTLLYHAKNCEANDGESLAYIEMHREMFAELLAYISEFAKRYTLANDRLEKINMFFEQNKKGDIKVIAKSFDKLKVFNAFGAPRDFEFFETTIKRKRYYNIKELLNATIIYQSITGLYEARKRLED

SEQ ID NO: 239 - protein, 952 aa, Listeria ivanovii
MKKMLANIDGADYFIDQIEEENFLRKQRTFDNGTIPHQLHLEELEAILHQQAKYYPFLRKDYEKIRSLVTFRIPYFIGPLANGQSDFAWLTRKADGEIRPWNIEEKVDFGKSAIDFIEKMTNKDTYLPKENVLPKHSLCYQKYMVYNELTKIRYIDDQGKTHHFSGQEKQQIFNGLFKQQRKVKKKDLERFLYTINHIESPTIEGVEDAFNSSFATYHDLQKGGVTQEILDNPLNADMLEEIVKILTVFEDKRMIKEQLQSFSDVLDGTILKKLERRHYTGWGRLSAKLLTGIRDKHSHLTILDYLMDDGLNRNLMQLINDSNLSFKSIIEKEQVSTADKGIQSIVAELAGSPAIKKGILQSLKIVDELVGIMGYPPQTIVVEMARENQTTGKGKNNSKPRFISLEKAIKEFGSQILKEHPTDNQCLKNDRLYLYYLQNGKDMYTGKELDIHNLSNYDIDHIIPQSFITDNSIDNRVLVSSTANREKGDNVPLLEVVRKRKAFWEKLYQAKLMSKRKFDYLTKAERGGLTEADKANFIQRQLVETRQITKNVANILYQRFNCKQDENGNEVEQVRIVTLKSTLVSQFRKQFQLYKVREVNDYHHAHDAYLNGVVANTLLKVYPQLEPEFVYGDYHQFDWFKANKATAKKQFYTNIMRFFAKENQIIDKNGEILWDNRYLDTIKKVLSYRQMNIVKKTEIQKGEFSNATVNPKGNSSKLISRKADWNPIKYGGFDGSNMAYSIVIEYEKRKKKTVIKKELIQINIMERVAFEKDQKAFLEEKGYYSPKVLTKIPKYTLYECENGRRRMLGSANEAQKGNQMVLPNHLMTLLYHAKNCEANDGESLAYIEMHREMFAELLAYISEFAKRYTLANDRLEKINMFFEQNKKGDIKVIAKSFDKLKVFNAFGAPRDFEFFETTIKRKRYYNIKELLNATIIYQSITGLYEARKRLED

SEQ ID NO: 240 - protein, 1327 aa, Listeria monocytogenes
MKNPYTIGLDIGTNSVGWAVLTNQYDLVKRKMKVAGNSDKKQIKKNFWGVRLFDDGQTAVDRRMNRTARRRIERRRNRISYLQEIFAVEMANIDANFFCRLNDSFYVDSEKRNSRHPFFATIEEEVAYHDNYRTIYHLREKLVNSSEKADLRLVYLALAHIIKYRGNFLIEGALDTKNTSVDEVYKQFIETYNQVFMSNIEKVEENIEVANILAGKFTRREKFERILQLYPGEKSTGMFAQFISLIVGSKGNFQKVFDLIEKTDIECAKDSYEEDLETLLAIIGDEYAELFVAAKNTYNAVVLSSIITVTDTETNAKLSASMIERFDAHEKDLVELKAFIKLNLPKQYEEIFSNAAIDGYAGYIDGTKQVDFYKYLKTILENIEGSDYFIAKIEEENFLRKQRTFDNGAIPHQLHLEELEAIIHQQAKYYPFLKEDYDKIKSLVTFRIPYFVGPLANGQSEFAWLTRKADGEIRPWNIEEKVDFGKSAVDFIEKMTNKDTYLPKENVLPKHSLCYQKYMVYNELTKIRYIDDQGKTNYFSGREKQQVFNDLFKQKRKVKKKDLELFLRNINHIESPTIEGLEDSFNASYATYHDLLKVGMKQEILDNPLNTEMLEDIVKILTVFEDKPMIKEQLQQFSDVLDGGVLKKLERRHYTGWGRLSAKLLVGIREKQSHLTILDYLMDDGLNRNLMQLINDSNLSFKSIIEKEQVSTTDKDLQSIVAELAGSPAIKKGILQSLKIVDELVSIMGYPPQTIVVEMARENQTTGKGKNNSKPRYKSLEKAIKEFGSQILKEHPTDNQELKNNRLYLYYLQNGKDMYTGQELDIHNLSNYDIDHIVPQSFITDNSIDNLVLTSSAGNREKGGDVPPLEIVRKRKVFWEKLYQGNLMSKRKFDYLTKAERGGLTEADKARFIHRQLVETRQITKNVANILYQRFNKETDNHGNTMEQVRIVTLKSALVSQFRKQFQLYKVREVNGYHHAHDAYLNGVVANTLLKVYPQLEPEFVYGEYHQFDWFKANKATAKKQFYTNIMLFFAQKERIIDENGEILWDKKYLETIKKVLDYRQMNIVKKTEIQKGEFSKATIKPKGNSSKLIPRKENWDPMKYGGLDSPNMAYAVIIEHAKGKKKIVIEKKLIQINIMERKMFEKDEEAFLEEKGYRHPKVLTKLPKYTLYECEKGRRRMLASANEAQKGNQLVLSNHLVSLLYHAKNCEASDGKSLKYIEAHRETFSELLAQVSEFATRYTLADANLSKINNLFEQNKEGDIKAIAQSFVDLMAFNAMGAPASFKFFEATIDRKRYTNLKELLSSTIIYQSITGLYESRKRLDD

SEQ ID NO: 241 - protein, 1327 aa, Listeria monocytogenes
MKNPYTIGLDIGTNSVGWAVLTDQYDLVKRKMKVAGNSDKKQIKKNFWGVRLFDDGQTAVDRRMNRTARRRIERRRNRISYLQEIFAVEMANIDANFFCRLNDSFYVDSEKRNSRHPFFATIEEEVAYHKNYRTIYHLREELVNSSEKADLRLVYLALAHIIKYRGNFLIEGALDTKNTSVDEVYKQFIQTYNQVFMSNIEKVEENTEVASILAGKFTRREKFERILRLYPGEKSTGMFAQFISLIVGNKGNFQKVFNLVEKTDIECAKDSYEEDLEALLAIIGDEYAELFVAAKNTYNAVVLSSIITVTATETNAKLSASMIERFDAHEKELGELKAFIKLHLPKQYQEIFNNAEIDGYAGYIDGTKQVDFYKYLKTTLENVEGADYFITKIEEENFLRKQRTFDNGVIPHQLHLEELEAILHQQAKYYPFLREGYDKIKSLVTFRIPYFVGPLANGQSEFAWLTRKDDGEIRPWNIEEKVDFGKSAVDFIEKMTNKDTYLPKENVLPKHSLCYQKYMVYNELTKIRYIDDQGKTNYFSGREKQQIFNDLFKQKRKVKKKDLELFLRNINHIESPTIEGLEDSFNASYATYHDLLKVGLKQEILDNPLNTEILEDIVKILTVFEDKRMIKEQLEQFSDVLDGVVLKKLERRHYTGWGRLSAKLLVGIRDKQSHLTILDYLMDDGLNRNLMQLINDSNLSFKSIIEKEQVSTTDKDLQSIVADLAGSPAIKKGILQSLKIVDELVSIMGYPPQTIVVEMARENQTTGKGKNNSKPRYKSLEKAIKDFGSQILKEHPTDNQELKNNRLYLYYLQNGKDIYTGQELDIHNLSNYDIDHIVPQSFITDNSIDNLVLTSSAGNREKGGDVPPLEIVRKRKVFWEKLYQGNLMSKRKFDYLTKAERGGLTEADKARFIHRQLVETRQITKNVANILHQRFNKETDNHGNTMEQVRIVTLKSALVSQFRKQFQLYKVREVNDYHHAHDAYLNGVVANTLLKVYPQLEPEFVYGEYHQFDWFKANKATAKKQFYTNIMLFFAQKERIIDENGEILWDKKYLETIKKVLDYRQINIVKKTEIQKGEFSKATIKPKGNSSKLIPRKENWDPMKYGGLDSPNMAYAVIIEHAKGKKKIVIEKKLIQINIMERKMFEKDEEAFLEEKGYHQPKVLTKLPKYTLYECEKGRRRMLSSANEAQKGNQLVLSNHLVSLLYHAKNCEASDGKSLKYIEAHRETFSELLAQVSEFATKYTLADANLSKINNLFEQNKEGDIKAIAQSFVDLMAFNAMGAPASFKFFEATIDRKRYTNLKELLSSTIIYQSITGLYESRKRLDD

SEQ ID NO: 242 - protein, 1327 aa, Listeria monocytogenes
MKNPYTIGLDIGTNSVGWAVLTDQYDLVKRKMKVAGNSDKKQIKKNFWGVRLFDDGQTAVDRRMNRTARRRIERRRNRISYLQEIFAVEMANIDANFFCRLNDSFYVDSEKRNSRHPFFATIEEEVAYHKNYRTIYHLREELVNSSEKADLRLVYLALAHIIKYRGNFLIEGALDTKNTSVDEVYKQFIQTYNQVFMSNIEKVEENTEVASILAGKFTRREKFERILRLYPGEKSTGMFAQFISLIVGNKGNFQKVFNLVEKTDIECAKDSYEEDLEALLAIIGDEYAELFVAAKNTYNAVVLSSIITVTATETNAKLSASMIERFDAHEKELGELKAFIKLHLPKQYQEIFNNAEIDGYAGYIDGTKQVDFYKYLKTTLENVEGADYFITKIEEENFLRKQRTFDNGVIPHQLHLEELEAILHQQAKYYPFLREGYDKIKSLVTFRIPYFVGPLANGQSEFAWLTRKDDGEIRPWNIEEKVDFGKSAVDFIEKMTNKDTYLPKENVLPKHSLCYQKYMVYNELTKIRYIDDQGKTNYFSGREKQQIFNDLFKQKRKVKKKDLELFLRNINHIESPTIEGLEDSFNASYATYHDLLKVGLKQEILDNPLNTEILEDIVKILTVFEDKRMIKEQLEQFSDVLDGVVLKKLERRHYTGWGRLSAKLLVGIRDKQSHLTILDYLMDDGLNRNLMQLINDSNLSFKSIIEKEQVSTTDKDLQSIVADLAGSPAIKKGILQSLKIVDELVSIMGYPPQTIVVEMARENQTTGKGKNNSKPRYKSLEKAIKDFGSQILKEHPTDNQELKNNRLYLYYLQNGKDIYTGQELDIHNLSNYDIDHIVPQSFITDNSIDNLVLTSSAGNREKGGDVPPLEIVRKRKVFWEKLYQGNLMSKRKFDYLTKAERGGLTEADKARFIHRQLVETRQITKNVANILHQRFNKETDNHGNTMEQVRIVTLKSALVSQFRKQFQLYKVREVNDYHHAHDAYLNGVVANTLLKVYPQLEPEFVYGEYHQFDWFKANKATAKKQFYTNIMLFFAQKERIIDENGEILWDKKYLETIKKVLDYRQINIVKKTEIQKGEFSKATIKPKGNSSKLIPRKENWDPVKYGGLDSPNMAYAVIIEHAKGKKKIVIEKKLIQINIMERKMFEKDEEAFLEEKGYHQPKVLTKLPKYTLYECEKGRRRMLSSANEAQKGNQLVLSNHLVSLLYHAKNCEASDGKSLKYIEAHRETFSELLAQVSEFATKYTLADANLSKINNLFEQNKEGDIKAIAQSFVDLMAFNAMGAPASFKFFEATIDRKRYTNLKELLSSTIIYQSITGLYESRKRLDD

SEQ ID NO: 243 - protein, 1327 aa, Listeria monocytogenes
MKKPYTIGLDIGTNSVGWAVLTDQYDLVKRKMKISGDSEKKQIKKNFWGVRLFEKGETAAKRRMSRTARRRIERRRNRISYLQEIFAIQMNEVDDNFFNRLKESFYAESDKKYNRHPFFGTVEEEVAYYKDFPTIYHLRKELIDSQKKADLRLVYLALAHIIKYRGHFLIEGALDTKNTSIDEMFKQFLQIYNQVFANDIEKTEKNQEVAQILAEKFTRKDKLDKILSLYPGEKTTGVFAQFVNIIVGSTGKFKKHFNLHEKKDINCAEDTYDTDLESLLAIIGDEFAEVFVAAKNAYNAVVLSNIITVTDSTTRAKLSASLIERFENHKEDLKKMKRFVRTYLPEKYDEIFDDTEKHGYAGYISGTKQADFYKYMKATLEKIEGADYFIAKIEEENFLRKQRTFDNGVIPHQLHLEELEAILHQQAKYYPFLREDYEKIKSLVTFRIPYFVGPLAKGQSEFAWLTRKADGEIRPWNIEEKVDFGKSAVDFIEKMTNKDTYLPKENVLPKHSLCYQKYMVYNELTKVRYIDDQGKTNYFSGQEKQQIFNDLFKQKRKVKKKDLELFLRNINQIESPTIEGLEDSFNASYATYHDLLKVGMKQEILDNPLNTEMLEDIVKILTVFEDKRMIKEQLQQFSDVLDGTVLKKLERRHYTGWGRLSAKLLVGIRDKQSHLTILDYLMDDGLNRNLMQLINDSNLSFKSIIEKEQVSTTDKDLQSIVAELAGSPAIKKGILQSLKIVDELVSVMGYPPQTIVVEMARENQTTNKGKNNSKPRYKSLEKAIKEFGSQILKEHPTDNQELKNNRLYLYYLQNGKDMYTGQELDIHNLSNYDIDHIVPQSFITDNSVDNLVLTSSAGNREKGDNVPPLEIVQKRKIFWEKLYQGNLMSKRKFDYLTKAERGGLTEADKARFIHRQLVETRQITKNVANILHQRFNYKTDGNKDTMETVRIVTLKSALVSQFRKQFQFYKVREVNDYHHAHDAYLNGVVANTLLKVYPQLEPEFVYGEYHQFGWFKANKATAKKQFYTNIMLFFAQKDRIIDENGEILWDKRYLETVKKVLGYRQMNIVKKTEIQKGEFSNVTPNPKGKSNKLIPRKKDWDPIKYGGFDGSKMAYAIIIEYEKQKRKVRIEKKLIQINIMEREAFEKDEKTFLEEKGYHQPKVLIKVPKYTLYECKNGRRRMLGSANEAHKGNQMLLPNHLMALLYHAEKYEAIDGESLAYIEVHRALFDELLAYISEFARKYTLSNDRLDEINMLYERNKDGDVKSIAESFVSLKKFNAFGVHQDFSFFGTKIERKRDRKLNELLNSTIIYQSITGLYESRKRLDN

SEQ ID NO: 244 - protein, 1327 aa, Listeria monocytogenes
MKNPYTIGLDIGTNSVGWAVLTDQYDLVKRKMKVAGNSDKKQIKKNFWGVRLFDEGETAADRRMNRTARRRIERRRNRISYLQEIFALEMANIDANFFCRLNDSFYVDSEKRNSRHPFFATIEEEVAYHKNYRTIYHLREELVNSSEKADLRLVYLALAHIIKYRGNFLIEGALDTKNTSVDGVYKQFIQTYNQVFISNIEKMEENTTVADILAGKFTRKEKLERILQLYPGEKSTGMFAQFISLIVGSKGNFQKVFDLVEKTDIECAKDSYEEDLEALLAIIGDEYAELFVAAKNTYNAVVLSSIITVTDTETNAKLSASMIERFDAHEKDLSELKAFIKLHLPKQYEEIFSNVAIDGYAGYIDGTKQVDFYKYLKTLLENIEGADYFIAKIEEENFLRKQRTFDNGAIPHQLHLEELEAILHQQAKYYPFLKEAYDKIKSLVTFRIPYFVGPLANGQSDFAWLTRKADGEIRPWNIEEKVDFGKSAVDFIEKMTNKDTYLPKENVLPKHSLYYQKYMVYNELTKVRYIDDQGKTNYFSGQEKQQIFNDYFKQKRKVSKKDLEQFLRNMSHIESPTIEGLEDSFNSSYATYHDLLKVGIKQEVLENPLNTEMLEDIVKILTVFEDKRMIKEQLQQFSDVLDGAVLKKLERRHYTGWGRLSAKLLVGIRDKQSHLTILDYLMDDGLNRNLMQLINDSNLSFKSIIEKEQVSTTDKDLQSIVADLAGSPAIKKGILQSLKIVDELVSIMGYPPQTIVVEMARENQTTVKGKNNSRPRYKSLEKAIKEFGSQILKEHPTDNQELRNNRLYLYYLQNGKDMYTGQELDIHNLSNYDIDHIVPQSFITDNSIDNLVLTSSAGNREKGDDVPPLEIVRKRKVFWEKLFQGNLMSKRKFDYLTKAERGGLTEADKATFIHRQLVETRQITKNVANILHQRFNNETDNHGNNMEQVRIVMLKSALVSQFRKQFQLYKVREVNDYHHAHDAYLNGVVANTLLKVYPQLEPEFVYGEYHQFDWFKANKATAKKQFYTNIMLFFAQKERIIDENGEILWDKKYLETIKKVLDYRQMNIVKKTEIQKGEFSKATIKPKGNSSKLIPRKENWDPMKYGGLDSPNMAYAVIIEHAKGKKKVVFEKKIIRITIMERKAFEKDEKSFLEKQGYRQPKVLTKLPKYTLYECENGRRRMLASANEAQKGNQQVLKGQLITLLHHAKNCEASDGKSLDYIESNREMFGELLAHVSEFAKRYTLADANLSKINQLFEQNKDNDIKVIAQSFVNLMAFNAMGAPASFKFFEATIERKRYTNLKELLSATIIYQSITGLYEARKRLDG

SEQ ID NO: 245 - protein, 1327 aa, Listeria monocytogenes
MKNPYTIGLDIGTNSVGWAVLTNQYDLVKRKMKVAGNSDKKQIKKNFWGVRLFDDGQTAVDRRMNRTARRRIERRRNRISYLQEIFAVEMANIDANFFCRLNDSFYVDSEKRNSRHPFFATIEEEVAYHKNYRTIYHLREELVNSSEKADLRLVYLALAHIIKYRGNFLIEGALDTKNTSVDGVYEQFIQTYNQVFMSNIEKVEENIEVANILAGKFTRREKFERILQLYPGEKSTGMFAQFISLIVGSKGNFQKVFDLIEKTDIECAKDSYEEDLEALLAIIGDEYAELFVAAKNTYNAVVLSSIITVTATETNAKLSASMIERFDAHEKDLGELKAFIKLHLPKQYQEIFNNAAIDGYAGYIDGTKQVDFYKYLKTILENIEGADYFIAKIEEENFLRKQRTFDNGAIPHQLHLEELEAIIHQQAKYYPFLREDYEKIKSLVTFRIPYFVGPLAKGQSEFAWLTRKADGEIRPWNIEEKVDFGKSAVDFIEKMTNKDTYLPKENVLPKHSLCYQKYMVYNELTKVRYIDDQGKTNYFSGQEKQQIFNDLFKQKRKVKKKDLELFLRNINHIESPTIEGLEDSFNASYATYHDLLKVGMKQEILDNPLNTEMLEDIVKILTVFEDKPMIKEQLQQFSDVLDGGVLKKLERRHYTGWGRLSAKLLVGIREKQSHLTILDYLMDDGLNRNLMQLINDSNLSFKSIIEKEQVSTTDKDLQSIVADLAGSPAIKKGILQSLKIVDELVSIMGYPPQTIVVEMARENQTTGKGKNNSKPRYKSLEKAIKEFGSKILKEHPTDNQELKNNRLYLYYLQNGKDMYTGQELDIHNLSNYDIDHIVPQSFITDNSIDNLVLTSSAGNREKGGDVPPLEIVRKRKVFWEKLYQGNLMSKRKFDYLTKAERGGLTDADKARFIHRQLVETRQITKNVANILHQRFNNETDNHGNTMEQVRIVTLKSALVSQFRKQFQLYKVREVNDYHHAHDAYLNGVVANTLLKVYPQLEPEFVYGEYHQFDWFKANKATAKKQFYTNIMLFFGQKERIIDENGEILWDKKYLETIKKVLDYRQMNIVKKTEIQKGEFSKATIKPKGNSSKLIPRKENWDPMKYGGLDSPNMAYAVIIEHAKGKKKLIFEKKIIRITIMERKMFEKDEEAFLEEKGYRHPKVLTKLPKYTLYECEKGRRRMLASANEAQKGNQLVLSNHLVSLLYHAKNCEASDGKSLKYIEAHRETFSELLAQVSEFATRYTLADANLSKINNLFEQNKEGDIQAIAQSFVDLMAFNAMGAPASFKFFEATIDRKRYTNLKELLSSTIIYQSITGLYESRKRLDD

SEQ ID NO: 246 - protein, 1327 aa, Listeria monocytogenes
MKNPYTIGLDIGTNSVGWAVLTNQYDLVKRKMKVAGNSDKKQIKKNFWGVRLFDDGQTAVDRRMNRTARRRIERRRNRISYLQEIFAVEMANIDANFFCRLNDSFYVDSEKRNSRHPFFATIEEEVAYHKNYRTIYHLREELVNSSEKADLRLVYLALAHIIKYRGNFLIEGALDTKNTSVDGVYEQFILTYNQVFMSNIEKVEENIEVANILAGKFTRREKFERILQLYPGEKSTGMFAQFISLIVGSKGNFQKVFDLIEKTDIECAKDSYEEDLETLLAIIGDEYAELFVAAKNTYNAVVLSSIITVTDTETNAKLSASMIERFDAHEKDLVELKAFIKLNLPKQYEEIFSNAAIDGYAGYIDGTKQVDFYKYLKTTLENVEGADYFITKIEEENFLRKQRTFDNGVIPHQLHLEELEAILHQQAKYYPFLREDYEKIKSLVTFRIPYFVGPLAKGQSEFAWLTRKADGEIRPWNIEEKVDFGKSAVDFIEKMTNKDTYLPKENVLPKHSLCYQKYMVYNELTKIRYIDDQGKTNYFSGQEKQQIFNDLFKQKRKVKKKDLELFLRNINHVESPTIEGLEDSFNASYATYHDLMKVGIKQEILDNPLNTEMLEDIVKILTVFEDKRMIKEQLQQFSDVLDGTVLKKLERRHYTGWGRLSAKLLVGIRDKQSHLTILDYLMDDGLNRNLMQLINDSNLSFKSIIEKEQVSTADKDLQSIVADLAGSPAIKKGILQSLKVVEELVSVMGYPPQTIVVEMARENQTTNKGKNNSKPRYKSLEKAIKEFGSQILKEHPTDNQELKNNRLYLYYLQNGKDMYTGQELDIHNLSNYDIDHIVPQSFITDNSIDNLVLTSSAGNREKGDNVPPLEIVQKRKIFWEKLYQGNLMSKRKFDYLTKAERGGLTEADKARFIHRQLVETRQITKNVANILHQRFNYKTDDNEDTMEPVRIVTLKSALVSQFRKQFQLYKVREVNDYHHAHDAYLNGVVANTLLKVYPQLEPEFVYGEYHQFDWFKANKATAKKQFYTNIMLFFAQKERIIDENGEILWDKKYLETIKKVLNYRQMNIVKKTEIQKGEFSNQNPKPRGDSSKLIPKKTNLNPIKYGGFEGSNMAYAIIIEHEKRKKKVTIEKKLIQINIMERKAFEKDEKVFLEGKGYHQPKVLTKLPKYALYECENGRRRMLGSANEVHKGNQMLLPNHLMTLLYHAEKREAIDGESLAYIEAHKAVFGELLAHISEFARKYTLANDKLDEINMLYERNKDGDVKSIAESFVSLKKFNAFGVHKDFNFFGTTIKRKRDRKLKELLNSTIIYQSITGLYESRKRLDS

SEQ ID NO: 247 - protein, 1327 aa, Listeria monocytogenes
MKNPYTIGLDIGTNSVGWAVLTDQYDLVKRKMKVAGNSDKKQIKKNFWGVRLFDDGQTAVDRRMNRTARRRIERRRNRISYLQEIFAVEMANIDANFFCRLNDSFYVDSEKRNSRHPFFATIEEEVAYHKNYRTIYHLREELVNSSEKADLRLVYLALAHIIKYRGNFLIEGALDTKNTSVDGVYEQFIQTYNQVFMSNIEKVEENIEVANILAGKFTRREKFERILQLYPGEKSTGMFAQFISLIVGSKGNFQKVFDLIEKTDIECAKDSYEEDLETLLAIIGDEYAELFVAAKNTYNAVVLSSIITVNDTETNAKLSASMIERFDAHEKDLVELKAFIKLNLPKQYEEIFSNAAIDGYAGYIDGTKQVDFYKYLKTILENIEGSDYFIAKIEEENFLRKQRTFDNGAIPHQLHLEELEAIIHQQAKYYTFLKEDYDKIKSLVTFRIPYFVGPLANGQSEFAWLTRKADGEIRPWNIEEKVDFGKSAVDFIEKMTNKDTYLPKENVLPKHSLCYQKYMVYNELTKVRYIDDQGKTNYFSGQEKQQIFNDLFKQKRKVKKKDLELFLRNINQIESPTIEGLEDSFNASYATYHDLLKVGMKQEILDNPLNTEMLEDIVKILTVFEDKRMIKEQLQQFSDVLDGVVLKKLERRHYTGWGRLSAKLLVGIRDKQSHLTILEYLMDDGLNRNLMQLINDSNLSFKSIIEKEQVSTTDKDLQSIVAELAGSPAIKKGILQSLKIVDELVSIMGYPPQTIVVEMARENQTTGKGKNNSKPRYKSLEKAIKEFGSQILKEHPTDNQELKNNRLYLYYLQNGKDMYTGQELDIHNLSNYDIDHIVPQSFITDNSIDNLVLTSSAGNREKGGDVPPLEIVRKRKVFWEKLYQGNLMSKRKFDYLTKAERGGLTEADKARFIHRQLVETRQITKNVANILHQRFNKETDNHGNTMEQVRIVTLKSALVSQFRKQFQLYKVREVNDYHHAHDAYLNGVVANTLLKVYPQLEPEFVYGEYHQFDWFKANKATAKKQFYTNIMLFFAQKERIIDENGEILWDKKYLETIKKVLDYRQMNIVKKTEIQKGEFSKATIKPKGNSSKLIPRKENWDPMKYGGLDSPNMAYAVIIEHAKGKKRIVIEKKLIQINIMERKMFEKDEEAFLEEKGYRHPKVLTKLPKYTLYECEKGRRRMLASANEAQKGNQLVLSNHLVSLLYHAKNCEASDGKSLKYIEAHRETFSELLAQVSEFATRYTLADANLSKINNLFEQNKEGDIKAIAQSFVDLMAFNAMGAPASFKFFEATIDRKRYTNLKELLSSTIIYQSITGLYESRKRLDD

SEQ ID NO: 248 - protein, 1327 aa, Listeria monocytogenes
MKKPYTIGLDIGTNSVGWAVLTDQYDLVKRKMKISGDSEKKQIKKNFWGVRLFEKGETAAKRRMSRTARRRIERRRNRISYLQEIFAIQMNEVDDNFFNRLKESFYAESDKKYNRHPFFGTVEEEVAYYKDFPTIYHLRKELIDSQKKADLRLVYLALAHIIKYRGHFLIEGALDTKNTSIDEMFKQFLQIYNQVFANDIEKTEKNQEVAQILAEKFTRKDKLDKILSLYPGEKTTGVFAQFVNIIVGSTGKFKKHFNLHEKKDINCAEDTYDTDLESLLAIIGDEFAEVFVAAKNAYNAVVLSNIITVTDSTTRAKLSASLIERFENHKEDLKKMKRFVRTYLPEKYDEIFDDTEKHGYAGYISGTKQADFYKYMKATLEKIEGADYFIAKIEEENFLRKQRTFDNGVIPHQLHLEELEAILHQQAKYYPFLREDYEKIKSLVTFRIPYFVGPLAKGQSEFAWLTRKADGEIRPWNIEEKVDFGKSAVDFIEKMTNKDTYLPKENVLPKHSLCYQKYMVYNELTKVRYIDDQGKTNYFSGQEKQQIFNDLFKQKRKVKKKDLELFLRNINQIESPTIEGLEDSFNASYATYHDLLKVGMKQEILDNPLNTEMLEDIVKILTVFEDKRMIKEQLQQFSDVLDGTVLKKLERRHYTGWGRLSAKLLVGIRDKQSHLTILDYLMDDGLNRNLMQLINDSNLSFKSIIEKEQVSTADKDLQSIVADLAGSPAIKKGILQSLKIVDELVSVMGYPPQTIVVEMARENQTTNKGKNNSKPRYKSLEKAIKEFGSQILKEHPTDNQELKNNRLYLYYLQNGKDMYTGQELDIHNLSNYDIDHIVPQSFITDNSVDNLVLTSSAGNREKGDNVPPLEIVQKRKIFWEKLYQGNLMSKRKFDYLTKAERGGLTEADKARFIHRQLVETRQITKNVANILHQRFNYKTDGNKDTMETVRIVTLKSALVSQFRKQFQFYKVREVNDYHHAHDAYLNGVVANTLLKVYPQLEPEFVYGEYHQFDWFKANKATAKKQFYTNIMLFFAQKDRIIDENGEILWDKRYLETVKKVLGYRQMNIVKKTEIQKGEFSNVTPNPKGKSNKLIPRKKDWDPIKYGGFDGSKMAYAIIIEYEKQKRKVRIEKKLIQINIMEREAFEKDEKTFLEEKGYHQPKVLIKVPKYTLYECENGRRRMLGSANEAHKGNQMLLPNHLMALLYHAEKYEAIDGESLAYIEVHRALFDELLAYISEFARKYTLSNDRLDEINMLYERNKDGDVKSIAESFVSLKKFNAFGVHQDFSFFGTKIERKRDRKLNELLNSTIIYQSITGLYESRKRLDN

SEQ ID NO: 249 - protein, 1327 aa, Listeria monocytogenes
MKNPYTIGLDIGTNSVGWAVLTNQYDLVKRKMKVAGNSDKKQIKKNFWGVRLFDDGQTAVDRRMNRTARRRIERRRNRISYLQEIFAVEMANIDANFFCRLNDSFYVDSEKRNSRHPFFATIEEEVAYHKNYRTIYHLREELVNSSEKADLRLVYLALAHIIKYRGNFLIEGALDTKNTSVDGVYEQFIQTYNQVFMSNIEKVEENIEVANILARKFTRREKFERILQLYPGEKSTGMFAQFISLIVGSKGNFQKVFDLIEKTDIECAKDSYEEDLETLLAIIGDEYAELFVAAKNTYNAVVLSSIITVTDTETNAKLSASMIERFDAHEKDLVELKAFIKLNLPKQYEEIFSNAAIDGYAGYIDGTKQVDFYKYLKTILENIEGADYFIAKIEEENFLRKQRTFDNGAIPHQLHLEELEAIIHQQAKYYPFLREDYEKIKSLVTFRIPYFVGPLAKGQSEFAWLTRKADGEIRPWNIEEKVDFGKSAVDFIEKMTNKDTYLPKENVLPKHSLCYQKYMVYNELTKIRYIDDQGKTNYFSGQEKQQIFNDLFKQKRKVKKKDLELFLRNINHVESPTIEGLEDSFNASYATYHDLMKVGIKQEILDNPLNTEMLEDIVKILTVFEDKRMIKEQLQQFSDVLDGTVLKKLERRHYTGWGRLSAKLLVGIRDKQSHLTILDYLMDDGLNRNLMQLINDSNLSFKSIIEKEQVSTADKDLQSIVADLAGSPAIKKGILQSLKVVEELVSVMGYPPQTIVVEMARENQTTNKGKNNSKPRYKSLEKAIKEFGSQILKEHPTDNQELKNNRLYLYYLQNGKDMYTGQELDIHNLSNYDIDHIVPQSFITDNSIDNLVLTSSAGNREKGDNVPPLEIVQKRKIFWEKLYQGNLMSKRKFDYLTKAERGGLTEADKARFIHRQLVETRQITKNVANILHQRFNYKTDDNEDTMEPVRIVTLKSALVSQFRKQFQLYKVREVNDYHHAHDAYLNGVVANTLLKVYPQLEPEFVYGEYHQFDWFKANKATAKKQFYTNIMLFFAQKERIIDENGEILWDKKYLETIKKVLNYRQMNIVKKTEIQKGEFSNQNPKPRGDSSKLIPKKTNLNPIKYGGFEGSNMAYAIIIEHEKRKKKVTIEKKLIQINIMERKAFEKDEKVFLEGKGYHQPKVLTKLPKYALYECENGRRRMLGSANEVHKGNQMLLPNHLMTLLYHAEKREAIDGESLAYIEAHKAVFGELLAHISEFARKYTLANDKLDEINMLYERNKDGDVKSIAESFVSLKKFNAFGVHKDFNFFGTTIKRKRDRKLKELLNSTIIYQSITGLYESRKRLDS

SEQ ID NO: 250 - protein, 1327 aa, Listeria monocytogenes; identical to SEQ ID NO: 245

SEQ ID NO: 251 - protein, 1327 aa, Listeria monocytogenes; identical to SEQ ID NO: 249

SEQ ID NO: 252 - protein, 781 aa, Listeria monocytogenes
  misc_feature (721)..(721): Xaa can be any naturally occurring amino acid
IFNDLFKQKRKVKKKDLELFLRNINQIESPTIEGLEDSFNASYATYHDLLKVGMKQEILDNPLNTEMLEDIVKILTVFEDKRMIKEQLQQFSDVLDGVVLKKLERRHYTGWGRLSAKLLVGIRDKQSHLTILEYLMDDGLNRNLMQLINDSNLSFKSIIEKEQVSTTDKDLQSIVADLAGSPAIKKGILQSLKIVDELVSIMGYPPQTIVVEMARENQTTVKGKNNSRPRYKSLEKAIKEFGSQILKEHPTDNQELKNNRLYLYYLQNGKDIYTGQELDIHNLSNYDIDHIVPQSFITDNSIDNLVLTSSAGNREKGDDVPPLEIVRKRKVFWEKLYQGNLMSKRKFDYLTKAERGGLTEADKARFIHRQLVETRQITKNVANILHQRFNNETDNHGNTMEQVRIVTLKSALVSQFRKQFQLYKVREVNDYHHAHDAYLNGVVANTLLKVYPQLEPEFVYGEYHQFDWFKANKATAKKQFYTNIMLFFAQKERIIDENGEILWDKKYLETIKKVLDYRQMNIVKKTEIQKGEFSKATIKPKGNSSKLIPRKENWDPMKYGGLDSPNMAYAVIIEHAKGKKKIVIEKKLIQINIMERKMFEKDEEAFLEEKGYRHPKVLTKLPKYTLYECEKGRRRMLASANEAQKGNQLVLSNHLVSLLYHAKNCEASDGKSLKYTEAHRETFSELLAQVSEFATRYTLADANLSKINNLFEQNKEGDIKXIAQSFVDLMVFNAMGAPASFKFFEATIDRKRYTNLKELLSSTIIYQSITGLYESRKRLDD

SEQ ID NO: 253 - protein, 1327 aa, Listeria seeligeri
MKKPYTIGLDIGTNSVGWAALTDQYDLVKRKMKVAGNSEKKQIKKNLWGVRLVDEGKTAAHRRVNRTTRRRIERRRNRISYLQEIFTAEMFEVDANFFYRLEDSFYIESEKRQSRHPFFATIEEEVAYHENYRTIYHLREKLVNSSDKADLRLVYLALAHIIKYRGNFLIEGKLDTKNTSVDEVFKQFIKTYNQVFASDIERIEENNEVAKIFSEKLTKREKLDKILNLYPNEKSTDLFAQFISLIIGSKGNFKKFFNLTEKTDIECAKDSYEEDLEVLLARVGDEYAEIFVAAKNAYNAVVLSSIITVSNTETKAKLSASMIERFDKHDKDLKRMKAFFKVRLPENFNEVFNDVEKDGYAGYIEGTKQEAFYKYMKKMLEHVEGADYFINQIEEENFLRKQRTFDNGAIPHQLHLEELEAILHQQAKYYPFLKVDYEKIKSLVTFRIPYFVGPLANGQSEFSWLTRKADGEIRPWNIEEKVDFGKSAIDFIEKMTNKDTYLPKENVLPKHSMCYQKYMVYNELTKIRYTDDQGKTHYFSGQEKQQIFNDLFKQKRKVKKKDLELFLYNMNHVESPTVEGVEDAFNSSFTTYHDLQKVGVPQEILDDPLNTEMLEEIIKILTVFEDKRMINERLQEFSNVLDEAVLKKLERRHYTGWGRLSAKLLIGIRDKESHLTILDYLMDDKHNRNLMQLINDSNLSFKSIIEKEQVSTADKDIQSIVADLAGSPAIKKGILQSLKIVDELVGIMGYPPQTIVVEMARENQTTGKGKNNSKPRFTSLEKAIKELGSQILKEHPTDNQGLKNDRLYLYYLQNGKDMYTGQELDIHNLSNYDIDHVVPQSFITDNSIDNRVLASSAANREKGDNVPSLEVVRKRKVYWEKLYQAKLMSKRKFDYLTKAERGGLTEADKARFIHRQLVETRQITKNVANILHQRFNCKKDESGNVIEQVRIVTLKAALVSQFRKQFQLYKVREVNDYHHAHDAYLNCVVANTLLKVYPQLEPEFVYGDYHQFDWFKANKATAKKQFYTNIMLFFAKKDRIIDENGEILWDKKYLDTIKKVLNYRQMNIVKKTEIQKGEFSNATANPKGNSSKLIPRKADWDPIKYGGFDGSNMAYAIVIEHEKRKKKTVIKKELIQINIMERTAFEKDQKEFLEGKGYRNPKVITKIPKYTLYECENGRRRMLGSANEAQKGNQMVLPNHLMTLLYHAKNCEASDGKSLAYIESHREMFAELLDSISEFASRYTLADANLEKINTIFEQNKSGDVKVIAQSFVNLLEFNAMGAPASFKYFETNIERKRYNNLKELLNATIIYQSITGLYEARKRLDD

SEQ ID NO: 254 - protein, 1359 aa, Artificial Sequence; identical to SEQ ID NO: 228
  Synthetic Polypeptide

SEQ ID NO: 255 - protein, 1290 aa, Roseburia hominis
IVDYCIGLDLGTGSVGWAVVDMNHRLMKRNGKHLWGSRLFSNAETAATRRSSRSIRRRYNKRRERIRLLRAILQDMVLEKDPTFFIRLEHTSFLDEEDKAKYLGDNYNLFIDEDFNDYTYYHKYPTIYHLRKALCESTEKADPRLIYLALHHIVKYRGNFLYEGQKFNMDASNIEDKLSDVFTQFADFNNIPYEDDKKNLEILEILKKPLSKKAKVDEVMALISPEKEFKSAYKELVTGIAGNKMNVTKMILCESIKQGDSEIKLKFSDSNYDDQFSEVENDLGEYVEFIDSLHNIYSWVELQTIMGATHTDNASISEAMVSRYNKHHEDLQLLKKCIKDNVPKKYFDMFRNDSEKVKGYYNYINRKAPVDEFYKFVKKCIEKVDTPEAKQILHDIELENFLLKQNSRTNGSVPYQMQLDEMIKIIDNQAKYYPVLKEKREQLLSILTFRIPYYFGPLETSEHAWIKRLEGKENQRILPWNYQDTVDVDATAEGFIKRMRSYCTYFPDEEVLPKNSLIVSKYEVYNELNKIRVDDKLLEVDVKNDIYNELFMKNKTVTEKKLKNWLVNNQCCRKDAEIKGFQKENQFSTSLTPWIDFTNIFGKIDQSNFDLIEKIIYDLTVFEDKKIMKRRLKKKYALPDDKIKQILKLKYKDWSRLSKKLLDGIVADSVTVLDVLESRLNLMEIINDKELGYAQMIEEASSCPKDGKFTYEEVAKLAGSPALKRGIWQSLQIVEEITKVMKCRPKYIYIEFERSEEKERTESKIKKLENVYKDEQTSVLEELKGFDNTKKISSDSLFLYFTQLGKCMYSGKKLDIDSLDKYQIDHIVPQSLVKDDSFDNRVLVLPSENQRKLDDLVVPFDIRDKMYRFWKLLFDHELISPKKFYSLIKTEYTERDEERFINRQLVETRQITKNVTQIIEDHYSTTKVAAIRANLSHEFRVKNHIYKNRDINDYHHAHDAYIVALIGGFMRDRYPNMHDSKAVYSEYMKMFRNKNDQKGFVINSMNYPYEVDGKLIWNPDLINEIKKCFYYKDCYCTTKLDQKSGQMFNTVLPNDAHSAKGAVIPVNKNRKDVNKYGGFSGLQYVIAAIEGTKKKGKKLVKVRKLSGIPLYLKQADIKEQIEYVEKEEKLSDVKIIKNNIPLNQLIEIDGRQYLLTSECVNAMQLVLNEEQCKLIADIYNAIYKQDFDGLDNMLMIQLYLQLIDKLKTLYPIYMGIVEKFEKFVSISKEEKANVIQMLIIMHKGPQNGNIIYDDFNVGKRIGRLNGRTFYLNIEFISQSPTGIYTKKYKL

SEQ ID NO: 256 - protein, 1292 aa, Sharpea azabuensis
KDIRYSIGLDIGTNSVGWAVMDEHYELLKKGNHHMWGSRLFDAAEPAATRRASRSIRRRYNKRRERIRLLRDLLGDMVMEVDPTFFIRLLNVSFLDEEDKQKNLGDNYNLFIEKDFNDKTYYDKYPTIYHLRKELCENKEKADPRLIYLALHHIVKYRGNFLYEGQSFTMDNSDIEERLNSAIEKFMSINEFDNRIVSDINSMIAVLSKIYQRSKKADDLLKIMNPTKEEKAAYKEFTKALVGLKFNISKMILAQEVKKGDTDIVLEFSNANYDSTIDELQSELGEYIEFIEMLHNIYSWVELQAILGATHTDNPSISAAMVERYEEHKKDLRVLKKVIREELPDKYNEVFRKDNRKLHNYLGYIKYDTPVEEFYKYIKGLLAKVDTDEAREILERIDLEKFMLKQNSRTNGSIPYQMQKDEMIQIIDNQSVYYPQLKENRDKLISILEFRIPYYFGPLAHSEFAWIKKFEDKQKERILPWNYDQIVDIDATAEGFIERMKNTGTYFPDEPVMAKNSLTVSKFEVLNELNKIRINGKLIAVETKKELLSDLFMKNKTITDKKLKDWLVTHQYYDINEELKIEGYQKDLQFSTSLAPWIDFTKIFGEINASNYQLIEKIIYDISIFEDKKILKRRLKKVYQLDDLLVDKILKLNYTGWSRLSEKLLTGMTADKATVLFVLESNKNLMEIINDEKLGYKQIIEESNMQDIEGPFKYDEVKKLAGSPAIKRGIWQALLVVREITKFMKHEPSHIYIEFAREEQKVRKESKIAKLQKIYENLQTQVYESLKKEDAKKRMETDALYLYYLQMGKSMYSGKPLDIDKLSTYQIDHILPQSLIKDDSFDNRVLVLPEENQWKLDSETVPFEIRNKMIGFWQMLHENGLMSNKKFFSLIRTDFSDKDKERFINRQLVETRQIIKNVAVIINDHYTNTNIVTVRAELSHQFRERYKIYKNRDINDFHHAHDAYIACIVGQFMHQNFEHLDAKIIYGQYKKNYKKNYGFILNSMNHLQSDIDTGEVMWDPAKIGKIKSCFYYKDVYVTKKLEQNSGTLFNTVLPNDAHSEKGATVPLNKYRADVHKYGGFGNVQSIIVAIEGKKKKGKKLIDVRKLTSIPLHLKNAPVEEQLSYIASPEHEDLIDVRIVKEILKNQLIEIDGGLYYVTSEYVTARQLSLNEQSCKLISEIYAAMLKKRYEYLDEEEIFDLYLQLLQKMDTLYPAYKGIAKRFFDFKNIDVVEKCDVIQILIIMHAGPMNGNIMYDDFKFTNRIGRFTHKNIDLKTTFISTSVTGLFSKKYKL

SEQ ID NO: 257 - protein, 1359 aa, Artificial Sequence; identical to SEQ ID NO: 228
  Synthetic Polypeptide

SEQ ID NO: 258 - protein, 1359 aa, Artificial Sequence
  Synthetic Polypeptide
MDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDAIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 259 - protein, 1359 aa, Artificial Sequence; identical to SEQ ID NO: 11
  Synthetic Polypeptide

SEQ ID NO: 260 - protein, 1359 aa, Artificial Sequence; identical to SEQ ID NO: 258
  Synthetic Polypeptide

SEQ ID NO: 261-269 - skipped (9 entries)

SEQ ID NO: 270 - protein, 198 aa, Homo sapiens [sequence omitted]

SEQ ID NO: 271 - protein, 198 aa, Mus musculus
MDSLLMKQKKFLYHFKNVRWAKGRHETYLCYVVKRRDSATSCSLDFGHLRNKSGCHVELLFLRYISDWDLDPGRCYRVTWFTSWSPCYDCARHVAEFLRWNPNLSLRIFTARLYFCEDRKAEPEGLRRLHRAGVQIGIMTFKDYFYCWNTFVENRERTFKAWEGLHENSVRLTRQLRRILLPLYEVDDLRDAFRMLGF

SEQ ID NO: 272 - protein, 198 aa, Canis lupus
MDSLLMKQRKFLYHFKNVRWAKGRHETYLCYVVKRRDSATSFSLDFGHLRNKSGCHVELLFLRYISDWDLDPGRCYRVTWFTSWSPCYDCARHVADFLRGYPNLSLRIFAARLYFCEDRKAEPEGLRRLHRAGVQIAIMTFKDYFYCWNTFVENREKTFKAWEGLHENSVRLSRQLRRILLPLYEVDDLRDAFRTLGL

SEQ ID NO: 273 - protein, 199 aa, Bos taurus
MDSLLKKQRQFLYQFKNVRWAKGRHETYLCYVVKRRDSPTSFSLDFGHLRNKAGCHVELLFLRYISDWDLDPGRCYRVTWFTSWSPCYDCARHVADFLRGYPNLSLRIFTARLYFCDKERKAEPEGLRRLHRAGVQIAIMTFKDYFYCWNTFVENHERTFKAWEGLHENSVRLSRQLRRILLPLYEVDDLRDAFRTLGL

SEQ ID NO: 274 - protein, 429 aa, Mus musculus
MGPFCLGCSHRKCYSPIRNLISQETFKFHFKNLGYAKGRKDTFLCYEVTRKDCDSPVSLHHGVFKNKDNIHAEICFLYWFHDKVLKVLSPREEFKITWYMSWSPCFECAEQIVRFLATHHNLSLDIFSSRLYNVQDPETQQNLCRLVQEGAQVAAMDLYEFKKCWKKFVDNGGRRFRPWKRLLTNFRYQDSKLQEILRPCYIPVPSSSSSTLSNICLTKGLPETRFCVEGRRMDPLSEEEFYSQFYNQRVKHLCYYHRMKPYLCYQLEQFNGQAPLKGCLLSEKGKQHAEILFLDKIRSMELSQVTITCYLTWSPCPNCAWQLAAFKRDRPDLILHIYTSRLYFHWKRPFQKGLCSLWQSGILVDVMDLPQFTDCWTNFVNPKRPFWPWKGLEIISRRTQRRLRRIKESWGLQDLVNDFGNLQLGPPMS

SEQ ID NO: 275 - protein, 429 aa, Rattus rattus
MGPFCLGCSHRKCYSPIRNLISQETFKFHFKNLRYAIDRKDTFLCYEVTRKDCDSPVSLHHGVFKNKDNIHAEICFLYWFHDKVLKVLSPREEFKITWYMSWSPCFECAEQVLRFLATHHNLSLDIFSSRLYNIRDPENQQNLCRLVQEGAQVAAMDLYEFKKCWKKFVDNGGRRFRPWKKLLTNFRYQDSKLQEILRPCYIPVPSSSSSTLSNICLTKGLPETRFCVERRRVHLLSEEEFYSQFYNQRVKHLCYYHGVKPYLCYQLEQFNGQAPLKGCLLSEKGKQHAEILFLDKIRSMELSQVIITCYLTWSPCPNCAWQLAAFKRDRPDLILHIYTSRLYFHWKRPFQKGLCSLWQSGILVDVMDLPQFTDCWTNFVNPKRPFWPWKGLEIISRRTQRRLHRIKESWGLQDLVNDFGNLQLGPPMS

SEQ ID NO: 276 - protein, 370 aa, Macaca mulatta
MVEPMDPRTFVSNFNNRPILSGLNTVWLCCEVKTKDPSGPPLDAKIFQGKVYSKAKYHPEMRFLRWFHKWRQLHHDQEYKVTWYVSWSPCTRCANSVATFLAKDPKVTLTIFVARLYYFWKPDYQQALRILCQKRGGPHATMKIMNYNEFQDCWNKFVDGRGKPFKPRNNLPKHYTLLQATLGELLRHLMDPGTFTSNFNNKPWVSGQHETYLCYKVERLHNDTWVPLNQHRGFLRNQAPNIHGFPKGRHAELCFLDLIPFWKLDGQQYRVTCFTSWSPCFSCAQEMAKFISNNEHVSLCIFAARIYDDQGRYQEGLRALHRDGAKIAMMNYSEFEYCWDTFVDRQGRPFQPWDGLDEHSQALSGRLRAI

SEQ ID NO: 277 - protein, 384 aa, Pan troglodytes
MKPHFRNPVERMYQDTFSDNFYNRPILSHRNTVWLCYEVKTKGPSRPPLDAKIFRGQVYSKLKYHPEMRFFHWFSKWRKLHRDQEYEVTWYISWSPCTKCTRDVATFLAEDPKVTLTIFVARLYYFWDPDYQEALRSLCQKRDGPRATMKIMNYDEFQHCWSKFVYSQRELFEPWNNLPKYYILLHIMLGEILRHSMDPPTFTSNFNNELWVRGRHETYLCYEVERLHNDTWVLLNQRRGFLCNQAPHKHGFLEGRHAELCFLDVIPFWKLDLHQDYRVTCFTSWSPCFSCAQEMAKFISNNKHVSLCIFAARIYDDQGRCQEGLRTLAKAGAKISIMTYSEFKHCWDTFVDHQGCPFQPWDGLEEHSQALSGRLRAILQNQGN

SEQ ID NO: 278 - protein, 377 aa, Chlorocebus sabaeus
MNPQIRNMVEQMEPDIFVYYFNNRPILSGRNTVWLCYEVKTKDPSGPPLDANIFQGKLYPEAKDHPEMKFLHWFRKWRQLHRDQEYEVTWYVSWSPCTRCANSVATFLAEDPKVTLTIFVARLYYFWKPDYQQALRILCQERGGPHATMKIMNYNEFQHCWNEFVDGQGKPFKPRKNLPKHYTLLHATLGELLRHVMDPGTFTSNFNNKPWVSGQRETYLCYKVERSHNDTWVLLNQHRGFLRNQAPDRHGFPKGRHAELCFLDLIPFWKLDDQQYRVTCFTSWSPCFSCAQKMAKFISNNKHVSLCIFAARIYDDQGRCQEGLRTLHRDGAKIAVMNYSEFEYCWDTFVDRQGRPFQPWDGLDEHSQALSGRLRAI

SEQ ID NO: 279 - protein, 384 aa, Homo sapiens
MKPHFRNTVERMYRDTFSYNFYNRPILSRRNTVWLCYEVKTKGPSRPPLDAKIFRGQVYSELKYHPEMRFFHWFSKWRKLHRDQEYEVTWYISWSPCTKCTRDMATFLAEDPKVTLTIFVARLYYFWDPDYQEALRSLCQKRDGPRATMKIMNYDEFQHCWSKFVYSQRELFEPWNNLPKYYILLHIMLGEILRHSMDPPTFTFNFNNEPWVRGRHETYLCYEVERMHNDTWVLLNQRRGFLCNQAPHKHGFLEGRHAELCFLDVIPFWKLDLDQDYRVTCFTSWSPCFSCAQEMAKFISKNKHVSLCIFTARIYDDQGRCQEGLRTLAEAGAKISIMTYSEFKHCWDTFVDHQGCPFQPWDGLDEHSQDLSGRLRAILQNQEN

SEQ ID NO: 280 - protein, 373 aa, Homo sapiens
MKPHFRNTVERMYRDTFSYNFYNRPILSRRNTVWLCYEVKTKGPSRPRLDAKIFRGQVYSQPEHHAEMCFLSWFCGNQLPAYKCFQITWFVSWTPCPDCVAKLAEFLAEHPNVTLTISAARLYYYWERDYRRALCRLSQAGARVKIMDDEEFAYCWENFVYSEGQPFMPWYKFDDNYAFLHRTLKEILRNPMEAMYPHIFYFHFKNLRKAYGRNESWLCFTMEVVKHHSPVSWKRGVFRNQVDPETHCHAERCFLSWFCDDILSPNTNYEVTWYTSWSPCPECAGEVAEFLARHSNVNLTIFTARLYYFWDTDYQEGLRSLSQEGASVEIMGYKDFKYCWENFVYNDDEPFKPWKGLKYNFLFLDSKLQEILE

SEQ ID NO: 281 - protein, 382 aa, Homo sapiens
MNPQIRNPMERMYRDTFYDNFENEPILYGRSYTWLCYEVKIKRGRSNLLWDTGVFRGQVYFKPQYHAEMCFLSWFCGNQLPAYKCFQITWFVSWTPCPDCVAKLAEFLSEHPNVTLTISAARLYYYWERDYRRALCRLSQAGARVTIMDYEEFAYCWENFVYNEGQQFMPWYKFDENYAFLHRTLKEILRYLMDPDTFTFNFNNDPLVLRRRQTYLCYEVERLDNGTWVLMDQHMGFLCNEAKNLLCGFYGRHAELRFLDLVPSLQLDPAQIYRVTWFISWSPCFSWGCAGEVRAFLQENTHVRLRIFAARIYDYDPLYKEALQMLRDAGAQVSIMTYDEFEYCWDTFVYRQGCPFQPWDGLEEHSQALSGRLRAILQNQGN

SEQ ID NO: 282 - protein, 190 aa, Homo sapiens
MNPQIRNPMKAMYPGTFYFQFKNLWEANDRNETWLCFTVEGIKRRSVVSWKTGVFRNQVDSETHCHAERCFLSWFCDDILSPNTKYQVTWYTSWSPCPDCAGEVAEFLARHSNVNLTIFTARLYYFQYPCYQEGLRSLSQEGVAVEIMDYEDFKYCWENFVYNDNEPFKPWKGLKTNFRLLKRRLRESLQ

SEQ ID NO: 283 - protein, 199 aa, Homo sapiens
MEASPASGPRHLMDPHIFTSNFNNGIGRHKTYLCYEVERLDNGTSVKMDQHRGFLHNQAKNLLCGFYGRHAELRFLDLVPSLQLDPAQIYRVTWFISWSPCFSWGCAGEVRAFLQENTHVRLRIFAARIYDYDPLYKEALQMLRDAGAQVSIMTYDEFKHCWDTFVDHQGCPFQPWDGLDEHSQALSGRLRAILQNQGN

SEQ ID NO: 284 - protein, 200 aa, Homo sapiens
MALLTAETFRLQFNNKRRLRRPYYPRKALLCYQLTPQNGSTPTRGYFENKKKCHAEICFINEIKSMGLDETQCYQVTCYLTWSPCSSCAWELVDFIKAHDHLNLGIFASRLYYHWCKPQQKGLRLLCGSQVPVEVMGFPKFADCWENFVDHEKPLSFNPYKMLEELDKNSRAIKRRLERIKIPGVRAQGRYMDILCDAEV

SEQ ID NO: 285 - protein, 386 aa, Homo sapiens
MNPQIRNPMERMYRDTFYDNFENEPILYGRSYTWLCYEVKIKRGRSNLLWDTGVFRGPVLPKRQSNHRQEVYFRFENHAEMCFLSWFCGNRLPANRRFQITWFVSWNPCLPCVVKVTKFLAEHPNVTLTISAARLYYYRDRDWRWVLLRLHKAGARVKIMDYEDFAYCWENFVCNEGQPFMPWYKFDDNYASLHRTLKEILRNPMEAMYPHIFYFHFKNLLKACGRNESWLCFTMEVTKHHSAVFRKRGVFRNQVDPETHCHAERCFLSWFCDDILSPNTNYEVTWYTSWSPCPECAGEVAEFLARHSNVNLTIFTARLCYFWDTDYQEGLCSLSQEGASVKIMGYKDFVSCWKNFVYSDDEPFKPWKGLQTNFRLLKRRLREILQ

SEQ ID NO: 286 - protein, 236 aa, Homo sapiens
MTSEKGPSTGDPTLRRRIEPWEFDVFYDPRELRKEACLLYEIKWGMSRKIWRSSGKNTTNHVEVNFIKKFTSERDFHPSMSCSITWFLSWSPCWECSQAIREFLSRHPGVTLVIYVARLFWHMDQQNRQGLRDLVNSGVTIQIMRASEYYHCWRNFVNYPPGDEAHWPQYPPLWMMLYALELHCIILSLPPCLKISRRWQNHLTFFRLHLQNCHYQTIPPHILLATGLIHPSVAWR

SEQ ID NO: 287 - protein, 229 aa, Mus musculus
MSSETGPVAVDPTLRRRIEPHEFEVFFDPRELRKETCLLYEINWGGRHSVWRHTSQNTSNHVEVNFLEKFTTERYFRPNTRCSITWFLSWSPCGECSRAITEFLSRHPYVTLFIYIARLYHHTDQRNRQGLRDLISSGVTIQIMTEQEYCYCWRNFVNYPPSNEAYWPRYPHLWVKLYVLELYCIILGLPPCLKILRRKQPQLTFFTITLQTCHYQRIPPHLLWATGLK

SEQ ID NO: 288 - protein, 229 aa, Rattus rattus [sequence omitted]

SEQ ID NO: 289 - protein, 208 aa, Petromyzon marinus
MTDAEYVRIHEKLDIYTFKKQFFNNKKSVSHRCYVLFELKRRGERRACFWGYAVNKPQSGTERGIHAEIFSIRKVEEYLRDNPGQFTINWYSSWSPCADCAEKILEWYNQELRGNGHTLKIWACKLYYEKNARNQIGLWNLRDNGVGLNVMVSEHYQCCRKIFIQSSHNQLNENRWLEKTLKRAEKRRSELSIMIQVKILHTTKSPAV

SEQ ID NO: 290 - protein, 384 aa, Homo sapiens
MKPHFRNTVERMYRDTFSYNFYNRPILSRRNTVWLCYEVKTKGPSRPPLDAKIFRGQVYSELKYHPEMRFFHWFSKWRKLHRDQEYEVTWYISWSPCTKCTRDMATFLAEDPKVTLTIFVARLYYFWDPDYQEALRSLCQKRDGPRATMKIMNYDEFQHCWSKFVYSQRELFEPWNNLPKYYILLHIMLGEILRHSMDPPTFTFNFNNEPWVRGRHETYLCYEVERMHNDTWVLLNQRRGFLCNQAPHKHGFLEGRHAELCFLDVIPFWKLDLDQDYRVTCFTSWSPCFSCAQEMAKFISKNKHVSLCIFTARIYRRQGRCQEGLRTLAEAGAKISIMTYSEFKHCWDTFVDHQGCPFQPWDGLDEHSQDLSGRLRAILQNQEN

SEQ ID NO: 291 - protein, 184 aa, Homo sapiens
MDPPTFTFNFNNEPWVRGRHETYLCYEVERMHNDTWVLLNQRRGFLCNQAPHKHGFLEGRHAELCFLDVIPFWKLDLDQDYRVTCFTSWSPCFSCAQEMAKFISKNKHVSLCIFTARIYDDQGRCQEGLRTLAEAGAKISIMTYSEFKHCWDTFVDHQGCPFQPWDGLDEHSQDLSGRLRAILQ

SEQ ID NO: 292 - protein, 184 aa, Homo sapiens
MDPPTFTFNFNNEPWVRGRHETYLCYEVERMHNDTWVLLNQRRGFLCNQAPHKHGFLEGRHAELCFLDVIPFWKLDLDQDYRVTCFTSWSPCFSCAQEMAKFISKNKHVSLCIFTARIYRRQGRCQEGLRTLAEAGAKISIMTYSEFKHCWDTFVDHQGCPFQPWDGLDEHSQDLSGRLRAILQ

SEQ ID NO: 293 - protein, 1633 aa, Artificial Sequence
  Synthetic Polypeptide
MGSSHHHHHHMSSETGPVAVDPTLRRRIEPHEFEVFFDPRELRKETCLLYEINWGGRHSIWRHTSQNTNKHVEVNFIEKFTTERYFCPNTRCSITWFLSWSPCGECSRAITEFLSRYPHVTLFIYIARLYHHADPRNRQGLRDLISSGVTIQIMTEQESGYCWRNFVNYSPSNEAHWPRYPHLWVRLYVLELYCIILGLPPCLNILRRKQPQLTFFTIALQSCHYQRLPPHILWATGLKSGSETPGTSESATPESDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKLLKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDAIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLLLKLPKYSLFELENGRKRMLASAGELQKGNELALPSKYVNFLYLASHYEKLKGSPEDNEQKQLFVEQHKHYLDELLEQISEFSKRVILADANLDKVLSAYNKHRDKPIREQAENLLHLFTLTNLGAPAAFKYFDTTIDRKRYTSTKEVLDATLIHQSITGLYETRIDLSQLGGDSGGSPKKKRKV

SEQ ID NO: 294 - protein, 1623 aa, Artificial Sequence
  Synthetic Polypeptide
MSSETGPVAVDPTLRRRIEPHEFEVFFDPRELRKETCLLYEINWGGRHSIWRHTSQNTNKHVEVNFIEKFTTERYFCPNTRCSITWFLSWSPCGECSRAITEFLSRYPHVTLFIYIARLYHHADPRNRQGLRDLISSGVTIQIMTEQESGYCWRNFVNYSPSNEAHWPRYPHLWVRLYVLELYCLLLGLPPCLNILRRKQPQLTFFTIALQSCHYQRLPPHILWATGLKSGSETPGTSESATPESDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKLLKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDAIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLLLKLPKYSLFELENGRKRMLASAGELQKGNELALPSKYVNFLYLASHYEKLKGSPEDNEQKQLFVEQHKHYLDELLEQISEFSKRVILADANLDKVLSAYNKHRDKPIREQAENLLHLFTLTNLGAPAAFKYFDTTIDRKRYTSTKEVLDATLIHQSITGLYETRIDLSQLGGDSGGSPKKKRKV

SEQ ID NO: 295 - protein, 1630 aa, Artificial Sequence
  Synthetic Polypeptide
MTSEKGPSTGDPTLRRRIEPWEFDVFYDPRELRKEACLLYEIKWGMSRKIWRSSGKNTTNHVEVNFIKKFTSERDFHPSMSCSITWFLSWSPCWECSQAIREFLSRHPGVTLVIYVARLFWHMDQQNRQGLRDLVNSGVTIQIMRASEYYHCWRNFVNYPPGDEAHWPQYPPLWMMLYALELHCIILSLPPCLKISRRWQNHLTFFRLHLQNCHYQTIPPHILLATGLIHPSVAWRSGSETPGTSESATPESDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDAIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSGGSPKKKRKV

SEQ ID NO: 296 - protein, 1710 aa, Artificial Sequence
  Synthetic Polypeptide
MSSETGPVAVDPTLRRRIEPHEFEVFFDPRELRKETCLLYEINWGGRHSIWRHTSQNTNKHVEVNFIEKFTTERYFCPNTRCSITWFLSWSPCGECSRAITEFLSRYPHVTLFIYIARLYHHADPRNRQGLRDLISSGVTIQIMTEQESGYCWRNFVNYSPSNEAHWPRYPHLWVRLYVLELYCLLLGLPPCLNILRRKQPQLTFFTIALQSCHYQRLPPHILWATGLKSGSETPGTSESATPESDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKLLKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDAIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLLLKLPKYSLFELENGRKRMLASAGELQKGNELALPSKYVNFLYLASHYEKLKGSPEDNEQKQLFVEQHKHYLDELLEQISEFSKRVILADANLDKVLSAYNKHRDKPIREQAENLLHLFTLTNLGAPAAFKYFDTTIDRKRYTSTKEVLDATLIHQSITGLYETRIDLSQLGGDSGGSTNLSDLLEKETGKQLVIQESILMLPEEVEEVIGNKPESDILVHTAYDESTDENVMLLTSDAPEYKPWALVIQDSNGENKIKMLSGGSPKKKRKV

SEQ ID NO: 297 - protein, 1710 aa, Artificial Sequence
  Synthetic Polypeptide
MSSETGPVAVDPTLRRRIEPHEFEVFFDPRELRKETCLLYEINWGGRHSIWRHTSQNTNKHVEVNFIEKFTTERYFCPNTRCSITWFLSWSPCGECSRAITEFLSRYPHVTLFIYIARLYHHADPRNRQGLRDLISSGVTIQIMTEQESGYCWRNFVNYSPSNEAHWPRYPHLWVRLYVLELYCLLLGLPPCLNILRRKQPQLTFFTIALQSCHYQRLPPHILWATGLKSGSETPGTSESATPESDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKLLKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLLLKLPKYSLFELENGRKRMLASAGELQKGNELALPSKYVNFLYLASHYEKLKGSPEDNEQKQLFVEQHKHYLDELLEQISEFSKRVILADANLDKVLSAYNKHRDKPIREQAENLLHLFTLTNLGAPAAFKYFDTTIDRKRYTSTKEVLDATLIHQSITGLYETRIDLSQLGGDSGGSTNLSDLLEKETGKQLVIQESILMLPEEVEEVIGNKPESDILVHTAYDESTDENVMLLTSDAPEYKPWALVIQDSNGENKIKMLSGGSPKKKRKV

SEQ ID NO: 298 - protein, 1679 aa, Artificial Sequence
  Synthetic Polypeptide
MTDAEYVRIHEKLDIYTFKKQFFNNKKSVSHRCYVLFELKRRGERRACFWGYAVNKPQSGTERGIHAEIFSIRKVEEYLRDNPGQFTINWYSSWSPCADCAEKILEWYNQELRGNGHTLKIWACKLYYEKNARNQIGLWNLRDNGVGLNVMVSEHYQCCRKIFIQSSHNQLNENRWLEKTLKRAEKRRSELSIMIQVKILHTTKSPAVSGSETPGTSESATPESDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDAIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSGGSMTNLSDIIEKETGKQLVIQESILMLPEEVEEVIGNKPESDILVHTAYDESTDENVMLLTSDAPEYKPWALVIQDSNGENKIKML

SEQ ID NO: 299 - protein, 1689 aa, Artificial Sequence
  Synthetic Polypeptide
MTDAEYVRIHEKLDIYTFKKQFFNNKKSVSHRCYVLFELKRRGERRACFWGYAVNKPQSGTERGIHAEIFSIRKVEEYLRDNPGQFTINWYSSWSPCADCAEKILEWYNQELRGNGHTLKIWACKLYYEKNARNQIGLWNLRDNGVGLNVMVSEHYQCCRKIFIQSSHNQLNENRWLEKTLKRAEKRRSELSIMIQVKILHTTKSPAVSGSETPGTSESATPESDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSGGSTNLSDIIEKETGKQLVIQESILMLPEEVEEVIGNKPESDILVHTAYDESTDENVMLLTSDAPEYKPWALVIQDSNGENKIKMLSGGSPKKKRKV

SEQ ID NO: 300 - protein, 1655 aa, Artificial Sequence
  Synthetic Polypeptide
MDPPTFTFNFNNEPWVRGRHETYLCYEVERMHNDTWVLLNQRRGFLCNQAPHKHGFLEGRHAELCFLDVIPFWKLDLDQDYRVTCFTSWSPCFSCAQEMAKFISKNKHVSLCIFTARIYDDQGRCQEGLRTLAEAGAKISIMTYSEFKHCWDTFVDHQGCPFQPWDGLDEHSQDLSGRLRAILQSGSETPGTSESATPESDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDAIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSGGSMTNLSDIIEKETGKQLVIQESILMLPEEVEEVIGNKPESDILVHTAYDESTDENVMLLTSDAPEYKPWALVIQDSNGENKIKML

SEQ ID NO: 301 - protein, 1665 aa, Artificial Sequence
  Synthetic Polypeptide
MDPPTFTFNFNNEPWVRGRHETYLCYEVERMHNDTWVLLNQRRGFLCNQAPHKHGFLEGRHAELCFLDVIPFWKLDLDQDYRVTCFTSWSPCFSCAQEMAKFISKNKHVSLCIFTARIYDDQGRCQEGLRTLAEAGAKISIMTYSEFKHCWDTFVDHQGCPFQPWDGLDEHSQDLSGRLRAILQSGSETPGTSESATPESDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSGGSTNLSDIIEKETGKQLVIQESILMLPEEVEEVIGNKPESDILVHTAYDESTDENVMLLTSDAPEYKPWALVIQDSNGENKIKMLSGGSPKKKRKV

SEQ ID NO: 302 - protein, 1665 aa, Artificial Sequence
  Synthetic Polypeptide
MDPPTFTFNFNNEPWVRGRHETYLCYEVERMHNDTWVLLNQRRGFLCNQAPHKHGFLEGRHAELCFLDVIPFWKLDLDQDYRVTCFTSWSPCFSCAQEMAKFISKNKHVSLCIFTARIYRRQGRCQEGLRTLAEAGAKISIMTYSEFKHCWDTFVDHQGCPFQPWDGLDEHSQDLSGRLRAILQSGSETPGTSESATPESDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSGGSTNLSDIIEKETGKQLVIQESILMLPEEVEEVIGNKPESDILVHTAYDESTDENVMLLTSDAPEYKPWALVIQDSNGENKIKMLSGGSPKKKRKV

SEQ ID NO: 303 - protein, 4 aa, Artificial Sequence
  Synthetic Polypeptide
GGGS

SEQ ID NO: 304 - protein, 5 aa, Artificial Sequence
  Synthetic Polypeptide
GGGGS

SEQ ID NO: 305 - protein, 5 aa, Artificial Sequence
  Synthetic Polypeptide
EAAAK

SEQ ID NO: 306 - protein, 16 aa, Artificial Sequence
  Synthetic Polypeptide
SGSETPGTSESATPES

SEQ ID NO: 307 - protein, 4 aa, Artificial Sequence
  Synthetic Polypeptide
AGVF

SEQ ID NO: 308 - protein, 4 aa, Artificial Sequence
  Synthetic Polypeptide
GFLG

SEQ ID NO: 309 - protein, 5 aa, Artificial Sequence
  Synthetic Polypeptide
ALALA

SEQ ID NO: 310 - protein, 352 aa, Artificial Sequence
  Synthetic Polypeptide
  misc_feature (20)..(20): Xaa is C or S
  misc_feature (101)..(101): Xaa can be any naturally occurring amino acid
  misc_feature (106)..(106): Xaa is G or R
  misc_feature (223)..(223): Xaa is R or Q
  misc_feature (269)..(269): Xaa is F or C
MDYQVSSPIYDINYYTSEPXQKINVKQIAARLLPPLYSLVFIFGFVGNMLVILILINCKRLKSMTDIYLLNLAISDLFFLLTVPFWAHYAAAQWDFGNTMXQLLTXLYFIGFFSGIFFIILLTIDRYLAVVHAVFALKARTVTFGVVTSVITWVVAVFASLPGIIFTRSQKEGLHYTCSSHFPYSQYQFWKNFQTLKIVILGLVLPLLVMVICYSGILKTLLXCRNEKKRHRAVRLIFTIMIVYFLFWAPYNIVLLLNTFQEFFGLNNXSSSNRLDQAMQVTETLGMTHCCINPIIYAFVGEKFRNYLLVFFQKHIAKRFCKCCSIFQQEAPERASSVYTRSTGEQEISVGL

SEQ ID NO: 311 - DNA, 281 bp, Artificial Sequence
  Synthetic Polynucleotide
ctgcagcaaaccttcccttcactacaaaacttcattgcttggccaaaaagagagttaattcaatgtagacatctatgtaggcaattaaaaacctattgatgtataaaacagtttgcattcatggagggcaactaaatacattctaggactttataaaagatcactttttatttatgcacagggtggaacaagatggattatcaagtgtcaagtccaatctatgacatcaattattatacatcggagccctgccaaaaaatcaatgtgaagcaaatcgcagc

SEQ ID NO: 312 - DNA, 1059 bp, Artificial Sequence
  Synthetic Polynucleotide
atggattatcaagtgtcaagtccaatctatgacatcaattattatacatcggagccctgccaaaaaatcaatgtgaagcaaatcgcagcccgcctcctgcctccgctctactcactggtgttcatctttggttttgtgggcaacatgctggtcatcctcatcctgataaactgcaaaaggctgaagagcatgactgacatctacctgctcaacctggccatctctgacctgtttttccttcttactgtccccttctgggctcactatgctgccgcccagtgggactttggaaatacaatgtgtcaactcttgacagggctctattttataggcttcttctctggaatcttcttcatcatcctcctgacaatcgataggtacctggctgtcgtccatgctgtgtttgctttaaaagccaggacggtcacctttggggtggtgacaagtgtgatcacttgggtggtggctgtgtttgcgtctctcccaggaatcatctttaccagatctcaaaaagaaggtcttcattacacctgcagctctcattttccatacagtcagtatcaattctggaagaatttccagacattaaagatagtcatcttggggctggtcctgccgctgcttgtcatggtcatctgctactcgggaatcctaaaaactctgcttcggtgtcgaaatgagaagaagaggcacagggctgtgaggcttatcttcaccatcatgattgtttattttctcttctgggctccctacaacattgtccttctcctgaacaccttccaggaattctttggcctgaataattgcagtagctctaacaggttggaccaagctatgcaggtgacagagactcttgggatgacgcactgctgcatcaaccccatcatctatgcctttgtcggggagaagttcagaaactacctcttagtcttcttccaaaagcacattgccaaacgcttctgcaaatgctgttctattttccagcaagaggctcccgagcgagcaagctcagtttacacccgatccactggggagcaggaaatatctgtgggcttgtga

SEQ ID NO: 313 - protein, 352 aa, Artificial Sequence [sequence omitted]

SEQ ID NO: 314 - RNA, 100 nt, Artificial Sequence
  Synthetic Polynucleotide
  misc_feature (1)..(20): n is a, c, g, or u
nnnnnnnnnnnnnnnnnnnnguuuuagagcuagaaauagcaaguuaaaauaaggcuaguccguuaucaacuugaaaaaguggcaccgacucggugcuuuu

SEQ ID NO: 315 - protein, 1368 aa, Streptococcus pyogenes
MDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFVSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKQYRSTKEVLDATLIHQSITGLYETRIDLSQLGGD

SEQ ID NO: 316 - protein, 1368 aa, Streptococcus pyogenes
MDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFESPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKQYRSTKEVLDATLIHQSITGLYETRIDLSQLGGD

SEQ ID NO: 317 - protein, 1368 aa, Streptococcus pyogenes
MDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFESPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKQYRSTKEVLDATLIHQSITGLYETRIDLSQLGGD

SEQ ID NO: 318 - protein, 1053 aa, Staphylococcus aureus
MKRNYILGLDIGITSVGYGIIDYETRDVIDAGVRLFKEANVENNEGRRSKRGARRLKRRRRHRIQRVKKLLFDYNLLTDHSELSGINPYEARVKGLSQKLSEEEFSAALLHLAKRRGVHNVNEVEEDTGNELSTKEQISRNSKALEEKYVAELQLERLKKDGEVRGSINRFKTSDYVKEAKQLLKVQKAYHQLDQSFIDTYIDLLETRRTYYEGPGEGSPFGWKDIKEWYEMLMGHCTYFPEELRSVKYAYNADLYNALNDLNNLVITRDENEKLEYYEKFQIIENVFKQKKKPTLKQIAKEILVNEEDIKGYRVTSTGKPEFTNLKVYHDIKDITARKEIIENAELLDQIAKILTIYQSSEDIQEELTNLNSELTQEEIEQISNLKGYTGTHNLSLKAINLILDELWHTNDNQIAIFNRLKLVPKKVDLSQQKEIPTTLVDDFILSPVVKRSFIQSIKVINAIIKKYGLPNDIIIELAREKNSKDAQKMINEMQKRNRQTNERIEEIIRTTGKENAKYLIEKIKLHDMQEGKCLYSLEAIPLEDLLNNPFNYEVDHIIPRSVSFDNSFNNKVLVKQEENSKKGNRTPFQYLSSSDSKISYETFKKHILNLAKGKGRISKTKKEYLLEERDINRFSVQKDFINRNLVDTRYATRGLMNLLRSYFRVNNLDVKVKSINGGFTSFLRRKWKFKKERNKGYKHHAEDALIIANADFIFKEWKKLDKAKKVMENQMFEEKQAESMPEIETEQEYKEIFITPHQIKHIKDFKDYKYSHRVDKKPNRKLINDTLYSTRKDDKGNTLIVNNLNGLYDKDNDKLKKLINKSPEKLLMYHHDPQTYQKLKLIMEQYGDEKNPLYKYYEETGNYLTKYSKKDNGPVIKKIKYYGNKLNAHLDITDDYPNSRNKVVKLSLKPYRFDVYLDNGVYKFVTVKNLDVIKKENYYEVNSKCYEEAKKLKKISNQAEFIASFYKNDLIKINGELYRVIGVNNDLLNRIEVNMIDITYREYLENMNDKRPPHIIKTIASKTQSIKKYSTDILGNLYEVKSKKHPQIIKKG

SEQ ID NO: 319 - protein, 1053 aa, Staphylococcus aureus
MKRNYILGLAIGITSVGYGIIDYETRDVIDAGVRLFKEANVENNEGRRSKRGARRLKRRRRHRIQRVKKLLFDYNLLTDHSELSGINPYEARVKGLSQKLSEEEFSAALLHLAKRRGVHNVNEVEEDTGNELSTKEQISRNSKALEEKYVAELQLERLKKDGEVRGSINRFKTSDYVKEAKQLLKVQKAYHQLDQSFIDTYIDLLETRRTYYEGPGEGSPFGWKDIKEWYEMLMGHCTYFPEELRSVKYAYNADLYNALNDLNNLVITRDENEKLEYYEKFQIIENVFKQKKKPTLKQIAKEILVNEEDIKGYRVTSTGKPEFTNLKVYHDIKDITARKEIIENAELLDQIAKILTIYQSSEDIQEELTNLNSELTQEEIEQISNLKGYTGTHNLSLKAINLILDELWHTNDNQIAIFNRLKLVPKKVDLSQQKEIPTTLVDDFILSPVVKRSFIQSIKVINAIIKKYGLPNDIIIELAREKNSKDAQKMINEMQKRNRQTNERIEEIIRTTGKENAKYLIEKIKLHDMQEGKCLYSLEAIPLEDLLNNPFNYEVDHIIPRSVSFDNSFNNKVLVKQEENSKKGNRTPFQYLSSSDSKISYETFKKHILNLAKGKGRISKTKKEYLLEERDINRFSVQKDFINRNLVDTRYATRGLMNLLRSYFRVNNLDVKVKSINGGFTSFLRRKWKFKKERNKGYKHHAEDALIIANADFIFKEWKKLDKAKKVMENQMFEEKQAESMPEIETEQEYKEIFITPHQIKHIKDFKDYKYSHRVDKKPNRKLINDTLYSTRKDDKGNTLIVNNLNGLYDKDNDKLKKLINKSPEKLLMYHHDPQTYQKLKLIMEQYGDEKNPLYKYYEETGNYLTKYSKKDNGPVIKKIKYYGNKLNAHLDITDDYPNSRNKVVKLSLKPYRFDVYLDNGVYKFVTVKNLDVIKKENYYEVNSKCYEEAKKLKKISNQAEFIASFYKNDLIKINGELYRVIGVNNDLLNRIEVNMIDITYREYLENMNDKRPPHIIKTIASKTQSIKKYSTDILGNLYEVKSKKHPQIIKKG

SEQ ID NO: 320 - protein, 1121 aa, Streptococcus thermophilus
MSDLVLGLDIGIGSVGVGILNKVTGEIIHKNSRIFPAAQAENNLVRRTNRQGRRLTRRKKHRRVRLNRLFEESGLITDFTKISINLNPYQLRVKGLTDELSNEELFIALKNMVKHRGISYLDDASDDGNSSIGDYAQIVKENSKQLETKTPGQIQLERYQTYGQLRGDFTVEKDGKKHRLINVFPTSAYRSEALRILQTQQEFNPQITDEFINRYLEILTGKRKYYHGPGNEKSRTDYGRYRTSGETLDNIFGILIGKCTFYPDEFRAAKASYTAQEFNLLNDLNNLTVPTETKKLSKEQKNQIINYVKNEKAMGPAKLFKYIAKLLSCDVADIKGYRIDKSGKAEIHTFEAYRKMKTLETLDIEQMDRETLDKLAYVLTLNTEREGIQEALEHEFADGSFSQKQVDELVQFRKANSSIFGKGWHNFSVKLMMELIPELYETSEEQMTILTRLGKQKTTSSSNKTKYIDEKLLTEEIYNPVVAKSVRQAIKIVNAAIKEYGDFDNIVIEMARETNEDDEKKAIQKIQKANKDEKDAAMLKAANQYNGKAELPHSVFHGHKQLATKIRLWHQQGERCLYTGKTISIHDLINNSNQFEVDHILPLSITFDDSLANKVLVYATANQEKGQRTPYQALDSMDDAWSFRELKAFVRESKTLSNKKKEYLLTEEDISKFDVRKKFIERNLVDTRYASRVVLNALQEHFRAHKIDTKVSVVRGQFTSQLRRHWGIEKTRDTYHHHAVDALIIAASSQLNLWKKQKNTLVSYSEDQLLDIETGELISDDEYKESVFKAPYQHFVDTLKSKEFEDSILFSYQVDSKFNRKISDATIYATRQAKVGKDKADETYVLGKIKDIYTQDGYDAFMKIYKKDKSKFLMYRHDPQTFEKVIEPILENYPNKQINEKGKEVPCNPFLKYKEEHGYIRKYSKKGNGPEIKSLKYYDSKLGNHIDITPKDSNNKVVLQSVSPWRADVYFNKTTGKYEILGLKYADLQFEKGTGTYKISQEKYNDIKKKEGVDSDSEFKFTLYKNDLLLVKDTETKEQQLFRFLSRTMPKQKHYVELKPYDKQKFEGGEALIKVLGNVANSGQCKKGLGKSNISIYKVRTDVLGNQHIIKNEGDKPKLDF

SEQ ID NO: 321 - protein, 1121 aa, Streptococcus thermophilus
MSDLVLGLAIGIGSVGVGILNKVTGEIIHKNSRIFPAAQAENNLVRRTNRQGRRLTRRKKHRRVRLNRLFEESGLITDFTKISINLNPYQLRVKGLTDELSNEELFIALKNMVKHRGISYLDDASDDGNSSIGDYAQIVKENSKQLETKTPGQIQLERYQTYGQLRGDFTVEKDGKKHRLINVFPTSAYRSEALRILQTQQEFNPQITDEFINRYLEILTGKRKYYHGPGNEKSRTDYGRYRTSGETLDNIFGILIGKCTFYPDEFRAAKASYTAQEFNLLNDLNNLTVPTETKKLSKEQKNQIINYVKNEKAMGPAKLFKYIAKLLSCDVADIKGYRIDKSGKAEIHTFEAYRKMKTLETLDIEQMDRETLDKLAYVLTLNTEREGIQEALEHEFADGSFSQKQVDELVQFRKANSSIFGKGWHNFSVKLMMELIPELYETSEEQMTILTRLGKQKTTSSSNKTKYIDEKLLTEEIYNPVVAKSVRQAIKIVNAAIKEYGDFDNIVIEMARETNEDDEKKAIQKIQKANKDEKDAAMLKAANQYNGKAELPHSVFHGHKQLATKIRLWHQQGERCLYTGKTISIHDLINNSNQFEVDHILPLSITFDDSLANKVLVYATANQEKGQRTPYQALDSMDDAWSFRELKAFVRESKTLSNKKKEYLLTEEDISKFDVRKKFIERNLVDTRYASRVVLNALQEHFRAHKIDTKVSVVRGQFTSQLRRHWGIEKTRDTYHHHAVDALIIAASSQLNLWKKQKNTLVSYSEDQLLDIETGELISDDEYKESVFKAPYQHFVDTLKSKEFEDSILFSYQVDSKFNRKISDATIYATRQAKVGKDKADETYVLGKIKDIYTQDGYDAFMKIYKKDKSKFLMYRHDPQTFEKVIEPILENYPNKQINEKGKEVPCNPFLKYKEEHGYIRKYSKKGNGPEIKSLKYYDSKLGNHIDITPKDSNNKVVLQSVSPWRADVYFNKTTGKYEILGLKYADLQFEKGTGTYKISQEKYNDIKKKEGVDSDSEFKFTLYKNDLLLVKDTETKEQQLFRFLSRTMPKQKHYVELKPYDKQKFEGGEALIKVLGNVANSGQCKKGLGKSNISIYKVRTDVLGNQHIIKNEGDKPKLDF

SEQ ID NO: 322 - protein, 1388 aa, Streptococcus thermophilus
MTKPYSIGLDIGTNSVGWAVITDNYKVPSKKMKVLGNTSKKYIKKNLLGVLLFDSGITAEGRRLKRTARRRYTRRRNRILYLQEIFSTEMATLDDAFFQRLDDSFLVPDDKRDSKYPIFGNLVEEKVYHDEFPTIYHLRKYLADSTKKADLRLVYLALAHMIKYRGHFLIEGEFNSKNNDIQKNFQDFLDTYNAIFESDLSLENSKQLEEIVKDKISKLEKKDRILKLFPGEKNSGIFSEFLKLIVGNQADFRKCFNLDEKASLHFSKESYDEDLETLLGYIGDDYSDVFLKAKKLYDAILLSGFLTVTDNETEAPLSSAMIKRYNEHKEDLALLKEYIRNISLKTYNEVFKDDTKNGYAGYIDGKTNQEDFYVYLKNLLAEFEGADYFLEKIDREDFLRKQRTFDNGSIPYQIHLQEMRAILDKQAKFYPFLAKNKERIEKILTFRIPYYVGPLARGNSDFAWSIRKRNEKITPWNFEDVIDKESSAEAFINRMTSFDLYLPEEKVLPKHSLLYETFNVYNELTKVRFIAESMRDYQFLDSKQKKDIVRLYFKDKRKVTDKDIIEYLHAIYGYDGIELKGIEKQFNSSLSTYHDLLNIINDKEFLDDSSNEAIIEEIIHTLTIFEDREMIKQRLSKFENIFDKSVLKKLSRRHYTGWGKLSAKLINGIRDEKSGNTILDYLIDDGISNRNFMQLIHDDALSFKKKIQKAQIIGDEDKGNIKEVVKSLPGSPAIKKGILQSIKIVDELVKVMGGRKPESIVVEMARENQYTNQGKSNSQQRLKRLEKSLKELGSKILKENIPAKLSKIDNNALQNDRLYLYYLQNGKDMYTGDDLDIDRLSNYDIDHIIPQAFLKDNSIDNKVLVSSASNRGKSDDFPSLEVVKKRKTFWYQLLKSKLISQRKFDNLTKAERGGLLPEDKAGFIQRQLVETRQITKHVARLLDEKFNNKKDENNRAVRTVKIITLKSTLVSQFRKDFELYKVREINDFHHAHDAYLNAVIASALLKKYPKLEPEFVYGDYPKYNSFRERKSATEKVYFYSNIMNIFKKSISLADGRVIERPLIEVNEETGESVWNKESDLATVRRVLSYPQVNVVKKVEEQNHGLDRGKPKGLFNANLSSKPKPNSNENLVGAKEYLDPKKYGGYAGISNSFAVLVKGTIEKGAKKKITNVLEFQGISILDRINYRKDKLNFLLEKGYKDIELIIELPKYSLFELSDGSRRMLASILSTNNKRGEIHKGNQIFLSQKFVKLLYHAKRISNTINENHRKYVENHKKEFEELFYYILEFNENYVGAKKNGKLLNSAFQSWQNHSIDELCSSFIGPTGSERKGLFELTSRGSAADFEFLGVKIPRYRDYTPSSLLKDATLIHQSVTGLYETRIDLAKLGEG

SEQ ID NO: 323 - protein, 1388 aa, Streptococcus thermophilus
MTKPYSIGLAIGTNSVGWAVITDNYKVPSKKMKVLGNTSKKYIKKNLLGVLLFDSGITAEGRRLKRTARRRYTRRRNRILYLQEIFSTEMATLDDAFFQRLDDSFLVPDDKRDSKYPIFGNLVEEKVYHDEFPTIYHLRKYLADSTKKADLRLVYLALAHMIKYRGHFLIEGEFNSKNNDIQKNFQDFLDTYNAIFESDLSLENSKQLEEIVKDKISKLEKKDRILKLFPGEKNSGIFSEFLKLIVGNQADFRKCFNLDEKASLHFSKESYDEDLETLLGYIGDDYSDVFLKAKKLYDAILLSGFLTVTDNETEAPLSSAMIKRYNEHKEDLALLKEYIRNISLKTYNEVFKDDTKNGYAGYIDGKTNQEDFYVYLKNLLAEFEGADYFLEKIDREDFLRKQRTFDNGSIPYQIHLQEMRAILDKQAKFYPFLAKNKERIEKILTFRIPYYVGPLARGNSDFAWSIRKRNEKITPWNFEDVIDKESSAEAFINRMTSFDLYLPEEKVLPKHSLLYETFNVYNELTKVRFIAESMRDYQFLDSKQKKDIVRLYFKDKRKVTDKDIIEYLHAIYGYDGIELKGIEKQFNSSLSTYHDLLNIINDKEFLDDSSNEAIIEEIIHTLTIFEDREMIKQRLSKFENIFDKSVLKKLSRRHYTGWGKLSAKLINGIRDEKSGNTILDYLIDDGISNRNFMQLIHDDALSFKKKIQKAQIIGDEDKGNIKEVVKSLPGSPAIKKGILQSIKIVDELVKVMGGRKPESIVVEMARENQYTNQGKSNSQQRLKRLEKSLKELGSKILKENIPAKLSKIDNNALQNDRLYLYYLQNGKDMYTGDDLDIDRLSNYDIDHIIPQAFLKDNSIDNKVLVSSASNRGKSDDFPSLEVVKKRKTFWYQLLKSKLISQRKFDNLTKAERGGLLPEDKAGFIQRQLVETRQITKHVARLLDEKFNNKKDENNRAVRTVKIITLKSTLVSQFRKDFELYKVREINDFHHAHDAYLNAVIASALLKKYPKLEPEFVYGDYPKYNSFRERKSATEKVYFYSNIMNIFKKSISLADGRVIERPLIEVNEETGESVWNKESDLATVRRVLSYPQVNVVKKVEEQNHGLDRGKPKGLFNANLSSKPKPNSNENLVGAKEYLDPKKYGGYAGISNSFAVLVKGTIEKGAKKKITNVLEFQGISILDRINYRKDKLNFLLEKGYKDIELIIELPKYSLFELSDGSRRMLASILSTNNKRGEIHKGNQIFLSQKFVKLLYHAKRISNTINENHRKYVENHKKEFEELFYYILEFNENYVGAKKNGKLLNSAFQSWQNHSIDELCSSFIGPTGSERKGLFELTSRGSAADFEFLGVKIPRYRDYTPSSLLKDATLIHQSVTGLYETRIDLAKLGEG

SEQ ID NO: 324 - protein, 36 aa, Artificial Sequence
  Synthetic Polypeptide
  misc_feature (2)..(2): Xaa can be any naturally occurring amino acid
  misc_feature (4)..(26): Xaa can be any naturally occurring amino acid
  misc_feature (27)..(29): Xaa may be absent
  misc_feature (32)..(33): Xaa can be any naturally occurring amino acid
  misc_feature (34)..(35): Xaa may be absent
HXEXXXXXXXXXXXXXXXXXXXXXXXXXXPCXXXXC

SEQ ID NO: 325 - DNA, 3686 bp, Homo sapiens
cttcagatagattatatctggagtgaagaatcctgccacctatgtatctggcatagtattctgtgtagtgggatgagcagagaacaaaaacaaaataatccagtgagaaaagcccgtaaataaaccttcagaccagagatctattctctagcttattttaagctcaacttaaaaagaagaactgttctctgattcttttcgccttcaatacacttaatgatttaactccaccctccttcaaaagaaacagcatttcctacttttatactgtctatatgattgatttgcacagctcatctggccagaagagctgagacatccgttcccctacaagaaactctccccgggtggaacaagatggattatcaagtgtcaagtccaatctatgacatcaattattatacatcggagccctgccaaaaaatcaatgtgaagcaaatcgcagcccgcctcctgcctccgctctactcactggtgttcatctttggttttgtgggcaacatgctggtcatcctcatcctgataaactgcaaaaggctgaagagcatgactgacatctacctgctcaacctggccatctctgacctgtttttccttcttactgtccccttctgggctcactatgctgccgcccagtgggactttggaaatacaatgtgtcaactcttgacagggctctattttataggcttcttctctggaatcttcttcatcatcctcctgacaatcgataggtacctggctgtcgtccatgctgtgtttgctttaaaagccaggacggtcacctttggggtggtgacaagtgtgatcacttgggtggtggctgtgtttgcgtctctcccaggaatcatctttaccagatctcaaaaagaaggtcttcattacacctgcagctctcattttccatacagtcagtatcaattctggaagaatttccagacattaaagatagtcatcttggggctggtcctgccgctgcttgtcatggtcatctgctactcgggaatcctaaaaactctgcttcggtgtcgaaatgagaagaagaggcacagggctgtgaggcttatcttcaccatcatgattgtttattttctcttctgggctccctacaacattgtccttctcctgaacaccttccaggaattctttggcctgaataattgcagtagctctaacaggttggaccaagctatgcaggtgacagagactcttgggatgacgcactgctgcatcaaccccatcatctatgcctttgtcggggagaagttcagaaactacctcttagtcttcttccaaaagcacattgccaaacgcttctgcaaatgctgttctattttccagcaagaggctcccgagcgagcaagctcagtttacacccgatccactggggagcaggaaatatctgtgggcttgtgacacggactcaagtgggctggtgacccagtcagagttgtgcacatggcttagttttcatacacagcctgggctgggggtggggtgggagaggtcttttttaaaaggaagttactgttatagagggtctaagattcatccatttatttggcatctgtttaaagtagattagatcttttaagcccatcaattatagaaagccaaatcaaaatatgttgatgaaaaatagcaacctttttatctccccttcacatgcatcaagttattgacaaactctcccttcactccgaaagttccttatgtatatttaaaagaaagcctcagagaattgctgattcttgagtttagtgatctgaacagaaataccaaaattatttcagaaatgtacaactttttacctagtacaaggcaacatataggttgtaaatgtgtttaaaacaggtctttgtcttgctatggggagaaaagacatgaatatgattagtaaagaaatgacacttttcatgtgtgatttcccctccaaggtatggttaataagtttcactgacttagaaccaggcgagagacttgtggcctgggagagctggggaagcttcttaaatgagaaggaatttgagttggatcatctattgctggcaaagacagaagcctcactgcaagcactgcatgggcaagcttggctgtagaaggagacagagctggttgggaagacatggggaggaaggacaaggctagatcatgaagaaccttgacggcattgctccgtctaagtcatgagctgagcagggagatcctggttggtgttgcagaaggtttactctgtggccaaaggagggtcaggaaggatgagcatttagggcaaggagaccaccaacagccctcaggtcagggtgaggatggcctctgctaagctcaaggcgtgaggatgggaaggagggaggtattcgtaaggatgggaaggagggaggtattcgtgcagcatatgaggatgcagagtcagcagaactggggtggatttgggttggaagtgagggtcagagaggagtcagagagaatccctagtcttcaagcagattggagaaacccttgaaaagacatcaagcacagaaggaggaggaggaggtttaggtcaagaagaagatggattggtgtaaaaggatgggtctggtttgcagagcttgaacacagtctcacccagactccaggctgtctttcactgaatgcttctgacttcatagatttccttcccatcccagctgaaatactgaggggtctccaggaggagactagatttatgaatacacgaggtatgaggtctaggaacatacttcagctcacacatgagatctaggtgaggattgattacctagtagtcatttcatgggttgttgggaggattctatgaggcaaccacaggcagcatttagcacatactacacattcaataagcatcaaactcttagttactcattcagggatagcactgagcaaagcattgagcaaaggggtcccatagaggtgagggaagcctgaaaaactaagatgctgcctgcccagtgcacacaagtgtaggtatcattttctgcatttaaccgtcaataggcaaaggggggaagggacatattcatttggaaataagctgccttgagccttaaaacccacaaaagtacaatttaccagcctccgtatttcagactgaatgggggtggggggggcgccttaggtacttattccagatgccttctccagacaaaccagaagcaacagaaaaaatcgtctctccctccctttgaaatgaatataccccttagtgtttgggtatattcatttcaaagggagagagagaggtttttttctgttctgtctcatatgattgtgcacatacttgagactgttttgaatttgggggatggctaaaaccatcatagtacaggtaaggtgagggaatagtaagtggtgagaactactcagggaatgaaggtgtcagaataataagaggtgctactgactttctcagcctctgaatatgaacggtgagcattgtggctgtcagcaggaagcaacgaagggaaatgtctttccttttgctcttaagttgtggagagtgcaacagtagcataggaccctaccctctgggccaagtcaaagacattctgacatcttagtatttgcatattcttatgtatgtgaaagttacaaattgcttgaaagaaaatatgcatctaataaaaaacaccttctaaaataaaaaaaaaaaaaaaaaaaaaaaaaaa

SEQ ID NO: 326 - DNA, 3451 bp, Homo sapiens
cttcagatagattatatctggagtgaagaatcctgccacctatgtatctggcatagtctcatctggccagaagagctgagacatccgttcccctacaagaaactctccccgggtggaacaagatggattatcaagtgtcaagtccaatctatgacatcaattattatacatcggagccctgccaaaaaatcaatgtgaagcaaatcgcagcccgcctcctgcctccgctctactcactggtgttcatctttggttttgtgggcaacatgctggtcatcctcatcctgataaactgcaaaaggctgaagagcatgactgacatctacctgctcaacctggccatctctgacctgtttttccttcttactgtccccttctgggctcactatgctgccgcccagtgggactttggaaatacaatgtgtcaactcttgacagggctctattttataggcttcttctctggaatcttcttcatcatcctcctgacaatcgataggtacctggctgtcgtccatgctgtgtttgctttaaaagccaggacggtcacctttggggtggtgacaagtgtgatcacttgggtggtggctgtgtttgcgtctctcccaggaatcatctttaccagatctcaaaaagaaggtcttcattacacctgcagctctcattttccatacagtcagtatcaattctggaagaatttccagacattaaagatagtcatcttggggctggtcctgccgctgcttgtcatggtcatctgctactcgggaatcctaaaaactctgcttcggtgtcgaaatgagaagaagaggcacagggctgtgaggcttatcttcaccatcatgattgtttattttctcttctgggctccctacaacattgtccttctcctgaacaccttccaggaattctttggcctgaataattgcagtagctctaacaggttggaccaagctatgcaggtgacagagactcttgggatgacgcactgctgcatcaaccccatcatctatgcctttgtcggggagaagttcagaaactacctcttagtcttcttccaaaagcacattgccaaacgcttctgcaaatgctgttctattttccagcaagaggctcccgagcgagcaagctcagtttacacccgatccactggggagcaggaaatatctgtgggcttgtgacacggactcaagtgggctggtgacccagtcagagttgtgcacatggcttagttttcatacacagcctgggctgggggtggggtgggagaggtcttttttaaaaggaagttactgttatagagggtctaagattcatccatttatttggcatctgtttaaagtagattagatcttttaagcccatcaattatagaaagccaaatcaaaatatgttgatgaaaaatagcaacctttttatctccccttcacatgcatcaagttattgacaaactctcccttcactccgaaagttccttatgtatatttaaaagaaagcctcagagaattgctgattcttgagtttagtgatctgaacagaaataccaaaattatttcagaaatgtacaactttttacctagtacaaggcaacatataggttgtaaatgtgtttaaaacaggtctttgtcttgctatggggagaaaagacatgaatatgattagtaaagaaatgacacttttcatgtgtgatttcccctccaaggtatggttaataagtttcactgacttagaaccaggcgagagacttgtggcctgggagagctggggaagcttcttaaatgagaaggaatttgagttggatcatctattgctggcaaagacagaagcctcactgcaagcactgcatgggcaagcttggctgtagaaggagacagagctggttgggaagacatggggaggaaggacaaggctagatcatgaagaaccttgacggcattgctccgtctaagtcatgagctgagcagggagatcctggttggtgttgcagaaggtttactctgtggccaaaggagggtcaggaaggatgagcatttagggcaaggagaccaccaacagccctcaggtcagggtgaggatggcctctgctaagctcaaggcgtgaggatgggaaggagggaggtattcgtaaggatgggaaggagggaggtattcgtgcagcatatgaggatgcagagtcagcagaactggggtggatttgggttggaagtgagggtcagagaggagtcagagagaatccctagtcttcaagcagattggagaaacccttgaaaagacatcaagcacagaaggaggaggaggaggtttaggtcaagaagaagatggattggtgtaaaaggatgggtctggtttgcagagcttgaacacagtctcacccagactccaggctgtctttcactgaatgcttctgacttcatagatttccttcccatcccagctgaaatactgaggggtctccaggaggagactagatttatgaatacacgaggtatgaggtctaggaacatacttcagctcacacatgagatctaggtgaggattgattacctagtagtcatttcatgggttgttgggaggattctatgaggcaaccacaggcagcatttagcacatactacacattcaataagcatcaaactcttagttactcattcagggatagcactgagcaaagcattgagcaaaggggtcccatagaggtgagggaagcctgaaaaactaagatgctgcctgcccagtgcacacaagtgtaggtatcattttctgcatttaaccgtcaataggcaaaggggggaagggacatattcatttggaaataagctgccttgagccttaaaacccacaaaagtacaatttaccagcctccgtatttcagactgaatgggggtggggggggcgccttaggtacttattccagatgccttctccagacaaaccagaagcaacagaaaaaatcgtctctccctccctttgaaatgaatataccccttagtgtttgggtatattcatttcaaagggagagagagaggtttttttctgttctgtctcatatgattgtgcacatacttgagactgttttgaatttgggggatggctaaaaccatcatagtacaggtaaggtgagggaatagtaagtggtgagaactactcagggaatgaaggtgtcagaataataagaggtgctactgactttctcagcctctgaatatgaacggtgagcattgtggctgtcagcaggaagcaacgaagggaaatgtctttccttttgctcttaagttgtggagagtgcaacagtagcataggaccctaccctctgggccaagtcaaagacattctgacatcttagtatttgcatattcttatgtatgtgaaagttacaaattgcttgaaagaaaatatgcatctaataaaaaacaccttctaaaataaaaaaaaaaaaaaaaaaaaaaaaaaa

SEQ ID NO: 327 - protein, 352 aa, Homo sapiens [sequence omitted]

SEQ ID NO: 328 - protein, 354 aa, Mus musculus
MDFQGSVPTYSYDIDYGMSAPCQKINVKQIAAQLLPPLYSLVFIFGFVGNMMVFLILISCKKLKSVTDIYLLNLAISDLLFLLTLPFWAHYAANEWVFGNIMCKVFTGLYHIGYFGGIFFIILLTIDRYLAIVHAVFALKVRTVNFGVITSVVTWAVAVFASLPEIIFTRSQKEGFHYTCSPHFPHTQYHFWKSFQTLKMVILSLILPLLVMVICYSGILHTLFRCRNEKKRHRAVRLIFAIMIVYFLFWTPYNIVLLLTTFQEFFGLNNCSSSNRLDQAMQATETLGMTHCCLNPVIYAFVGEKFRSYLSVFFRKHMVKRFCKRCSIFQQDNPDRASSVYTRSTGEHEVSTGL

SEQ ID NO: 329 - protein, 354 aa, Rattus norvegicus
MDFQGSIPTYIYDIDYSMSAPCQKFNVKQIAAQLLPPLYSLVFIFGFVGNMMVFLILISCKKLKSMTDIYLFNLAISDLLFLLTLPFWAHYAANEWVFGNIMCKLFTGIYHIGYFGGIFFIILLTIDRYLAIVHAVFAIKARTVNFGVITSVVTWVVAVFVSLPEIIFMRSQKEGSHYTCSPHFPRIQYRFWKHFQTLKMVILSLILPLLVMVICYSGILNTLFRCRNEKKRHRAVRLIFAIMIVYFLFWTPYNIVLLLTTFQEYFGLNNCSSSNRLDQAMQVTETLGMTHCCLNPVIYAFVGEKFRNYLSVFFRKHIVKRFCKHCSIFQQVNPDRVSSVYTRSTGEQEVSTGL

SEQ ID NO: 330 - RNA, 82 nt, Artificial Sequence
  Synthetic Polynucleotide
guuuuagagcuagaaauagcaaguuaaaauaaaggcuaguccguuaucaacuugaaaaaguggcaccgagucggugcuuuuu

SEQ ID NO: 331 - RNA, 82 nt, Artificial Sequence
  Synthetic Polynucleotide
guuuuaguacucuggaaacagaaucuacuaaaacaaggcaaaaugccguguuuaucucgucaacuuguuggcgagauuuuuu

SEQ ID NO: 332 - DNA, 2689 bp, Homo sapiens
tttattctctggaacatgaaacattctgttgtgctcatatcatgcaaattatcactagtaggagagcagagagtggaaatgttccaggtataaagacccacaagataaagaagctcagagtcgttagaaacaggagcagatgtacagggtttgcctgactcacactcaaggttgcataagcaagatttcaaaattaatcctattctggagacctcaacccaatgtacaatgttcctgactggaaaagaagaactatatttttctgattttttttttcaaatctttaccattagttgccctgtatctccgccttcactttctgcaggaaactttatttcctacttctgcatgccaagtttctacctctagatctgtttggttcagttgctgagaagcctgacataccaggactgcctgagacaagccacaagctgaacagagaaagtggattgaacaaggacgcatttccccagtacatccacaacatgctgtccacatctcgttctcggtttatcagaaataccaacgagagcggtgaagaagtcaccaccttttttgattatgattacggtgctccctgtcataaatttgacgtgaagcaaattggggcccaactcctgcctccgctctactcgctggtgttcatctttggttttgtgggcaacatgctggtcgtcctcatcttaataaactgcaaaaagctgaagtgcttgactgacatttacctgctcaacctggccatctctgatctgctttttcttattactctcccattgtgggctcactctgctgcaaatgagtgggtctttgggaatgcaatgtgcaaattattcacagggctgtatcacatcggttattttggcggaatcttcttcatcatcctcctgacaatcgatagatacctggctattgtccatgctgtgtttgctttaaaagccaggacggtcacctttggggtggtgacaagtgtgatcacctggttggtggctgtgtttgcttctgtcccaggaatcatctttactaaatgccagaaagaagattctgtttatgtctgtggcccttattttccacgaggatggaataatttccacacaataatgaggaacattttggggctggtcctgccgctgctcatcatggtcatctgctactcgggaatcctgaaaaccctgcttcggtgtcgaaacgagaagaagaggcatagggcagtgagagtcatcttcaccatcatgattgtttactttctcttctggactccctataatattgtcattctcctgaacaccttccaggaattcttcggcctgagtaactgtgaaagcaccagtcaactggaccaagccacgcaggtgacagagactcttgggatgactcactgctgcatcaatcccatcatctatgccttcgttggggagaagttcagaagcctttttcacatagctcttggctgtaggattgccccactccaaaaaccagtgtgtggaggtccaggagtgagaccaggaaagaatgtgaaagtgactacacaaggactcctcgatggtcgtggaaaaggaaagtcaattggcagagcccctgaagccagtcttcaggacaaagaaggagcctagagacagaaatgacagatctctgctttggaaatcacacgtctggcttcacagatgtgtgattcacagtgtgaatcttggtgtctacgttaccaggcaggaaggctgagaggagagagactccagctgggttggaaaacagtattttccaaactaccttccagttcctcatttttgaatacaggcatagagttcagactttttttaaatagtaaaaataaaattaaagctgaaaactgcaacttgtaaatgtggtaaagagttagtttgagttactatcatgtcaaacgtgaaaatgctgtattagtcacagagataattctagctttgagcttaagaattttgagcaggtggtatgtttgggagactgctgagtcaacccaatagttgttgattggcaggagttggaagtgtgtgatctgtgggcacattagcctatgtgcatgcagcatctaagtaatgatgtcgtttgaatcacagtatacgctccatcgctgtcatctcagctggatctccattctctcaggcttgctgccaaaagccttttgtgttttgttttgtatcattatgaagtcatgcgtttaatcacattcgagtgtttcagtgcttcgcagatgtccttgatgctcatattgttccctattttgccagtgggaactcctaaatcaagttggcttctaatcaaagcttttaaaccctattggtaaagaatggaaggtggagaagctccctgaagtaagcaaagactttcctcttagtcgagccaagttaagaatgttcttatgttgcccagtgtgtttctgatctgatgcaagcaagaaacactgggcttctagaaccaggcaacttgggaactagactcccaagctggactatggctctactttcaggccacatggctaaagaaggtttcagaaagaagtggggacagagcagaactttcaccttcatatatttgtatgatcctaatgaatgcataaaatgttaagttgatggtgatgaaatgtaaatactgtttttaacaactatgatttggaaaataaatcaatgctataactatgttgaaaaaaaaaaaaaaaaaa

SEQ ID NO: 333 - DNA, 2335 bp, Homo sapiens
tttattctctggaacatgaaacattctgttgtgctcatatcatgcaaattatcactagtaggagagcagagagtggaaatgttccaggtataaagacccacaagataaagaagctcagagtcgttagaaacaggagcagatgtacagggtttgcctgactcacactcaaggttgcataagcaagatttcaaaattaatcctattctggagacctcaacccaatgtacaatgttcctgactggaaaagaagaactatatttttctgattttttttttcaaatctttaccattagttgccctgtatctccgccttcactttctgcaggaaactttatttcctacttctgcatgccaagtttctacctctagatctgtttggttcagttgctgagaagcctgacataccaggactgcctgagacaagccacaagctgaacagagaaagtggattgaacaaggacgcatttccccagtacatccacaacatgctgtccacatctcgttctcggtttatcagaaataccaacgagagcggtgaagaagtcaccaccttttttgattatgattacggtgctccctgtcataaatttgacgtgaagcaaattggggcccaactcctgcctccgctctactcgctggtgttcatctttggttttgtgggcaacatgctggtcgtcctcatcttaataaactgcaaaaagctgaagtgcttgactgacatttacctgctcaacctggccatctctgatctgctttttcttattactctcccattgtgggctcactctgctgcaaatgagtgggtctttgggaatgcaatgtgcaaattattcacagggctgtatcacatcggttattttggcggaatcttcttcatcatcctcctgacaatcgatagatacctggctattgtccatgctgtgtttgctttaaaagccaggacggtcacctttggggtggtgacaagtgtgatcacctggttggtggctgtgtttgcttctgtcccaggaatcatctttactaaatgccagaaagaagattctgtttatgtctgtggcccttattttccacgaggatggaataatttccacacaataatgaggaacattttggggctggtcctgccgctgctcatcatggtcatctgctactcgggaatcctgaaaaccctgcttcggtgtcgaaacgagaagaagaggcatagggcagtgagagtcatcttcaccatcatgattgtttactttctcttctggactccctataatattgtcattctcctgaacaccttccaggaattcttcggcctgagtaactgtgaaagcaccagtcaactggaccaagccacgcaggtgacagagactcttgggatgactcactgctgcatcaatcccatcatctatgccttcgttggggagaagttcagaaggtatctctcggtgttcttccgaaagcacatcaccaagcgcttctgcaaacaatgtccagttttctacagggagacagtggatggagtgacttcaacaaacacgccttccactggggagcaggaagtctcggctggtttataaaacgaggagcagtttgattgttgtttataaagggagataacaatctgtatataacaacaaacttcaagggtttgttgaacaatagaaacctgtaaagcaggtgcccaggaacctcagggctgtgtgtactaatacagactatgtcacccaatgcatatccaacatgtgctcagggaataatccagaaaaactgtgggtagagactttgactctccagaaagctcatctcagctcctgaaaaatgcctcattaccttgtgctaatcctctttttctagtcttcataatttcttcactcaatctctgattctgtcaatgtcttgaaatcaagggccagctggaggtgaagaagagaatgtgacaggcacagatgaatgggagtgagggatagtggggtcagggctgagaggagaaggagggagacatgagcatggctgagcctggacaaagacaaaggtgagcaaagggctcacgcattcagccaggagatgatactggtccttagccccatctgccacgtgtatttaaccttgaagggttcaccaggtcagggagagtttgggaactgcaataacctgggagttttggtggagtccgatgattctcttttgcataagtgcatgacatatttttgctttattacagtttatctatggcacccatgcaccttacatttgaaatctatgaaatatcatgctccattgttcagatgcttcttaggccacatccccctgtctaaaaattcagaaaatttttgtttataaaaga

SEQ ID NO: 334 - protein, 374 aa, Homo sapiens
MLSTSRSRFIRNTNESGEEVTTFFDYDYGAPCHKFDVKQIGAQLLPPLYSLVFIFGFVGNMLVVLILINCKKLKCLTDIYLLNLAISDLLFLITLPLWAHSAANEWVFGNAMCKLFTGLYHIGYFGGIFFIILLTIDRYLAIVHAVFALKARTVTFGVVTSVITWLVAVFASVPGIIFTKCQKEDSVYVCGPYFPRGWNNFHTIMRNILGLVLPLLIMVICYSGILKTLLRCRNEKKRHRAVRVIFTIMIVYFLFWTPYNIVILLNTFQEFFGLSNCESTSQLDQATQVTETLGMTHCCINPIIYAFVGEKFRSLFHIALGCRIAPLQKPVCGGPGVRPGKNVKVTTQGLLDGRGKGKSIGRAPEASLQDKEGA

SEQ ID NO: 335 - protein, 360 aa, Homo sapiens
MLSTSRSRFIRNTNESGEEVTTFFDYDYGAPCHKFDVKQIGAQLLPPLYSLVFIFGFVGNMLVVLILINCKKLKCLTDIYLLNLAISDLLFLITLPLWAHSAANEWVFGNAMCKLFTGLYHIGYFGGIFFIILLTIDRYLAIVHAVFALKARTVTFGVVTSVITWLVAVFASVPGIIFTKCQKEDSVYVCGPYFPRGWNNFHTIMRNILGLVLPLLIMVICYSGILKTLLRCRNEKKRHRAVRVIFTIMIVYFLFWTPYNIVILLNTFQEFFGLSNCESTSQLDQATQVTETLGMTHCCINPIIYAFVGEKFRRYLSVFFRKHITKRFCKQCPVFYRETVDGVTSTNTPSTGEQEVSAGL

SEQ ID NO: 336 - protein, 373 aa, Mus musculus
MEDNNMLPQFIHGILSTSHSLFTRSIQELDEGATTPYDYDDGEPCHKTSVKQIGAWILPPLYSLVFIFGFVGNMLVIIILIGCKKLKSMTDIYLLNLAISDLLFLLTLPFWAHYAANEWVFGNIMCKVFTGLYHIGYFGGIFFIILLTIDRYLAIVHAVFALKARTVTFGVITSVVTWVVAVFASLPGIIFTKSKQDDHHYTCGPYFTQLWKNFQTIMRNILSLILPLLVMVICYSGILHTLFRCRNEKKRHRAVRLIFAIMIVYFLFWTPYNIVLFLTTFQESLGMSNCVIDKHLDQAMQVTETLGMTHCCINPVIYAFVGEKFRRYLSIFFRKHIAKRLCKQCPVFYRETADRVSSTFTPSTGEQEVSVGL

SEQ ID NO: 337 - protein, 373 aa, Rattus norvegicus
MEDSNMLPQFIHGILSTSHSLFPRSIQELDEGATTPYDYDDGEPCHKTSVKQIGAWILPPLYSLVFIFGFVGNMLVIIILISCKKLKSMTDIYLFNLAISDLLFLLTLPFWAHYAANEWVFGNIMCKLFTGLYHIGYFGGIFFIILLTIDRYLAIVHAVFALKARTVTFGVITSVVTWVVAVFASLPGIIFTKSEQEDDQHTCGPYFPTIWKNFQTIMRNILSLILPLLVMVICYSGILHTLFRCRNEKKRHRAVRLIFAIMIVYFLFWTPYNIVLFLTTFQEFLGMSNCVVDMHLDQAMQVTETLGMTHCCVNPIIYAFVGEKFRRYLSIFFRKHIAKNLCKQCPVFYRETADRVSSTFTPSTGEQEVSVGL

SEQ ID NO: 338 - protein, 1367 aa, Artificial Sequence
  Synthetic Polypeptide
DKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTAFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGALSRKLINGIRDKQSGKTILDFLKSDGFANRNFMALIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRAITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 339 - protein, 1612 aa, Artificial Sequence
  Synthetic Polypeptide
MSSETGPVAVDPTLRRRIEPHEFEVFFDPRELRKETCLLYEINWGGRHSIWRHTSQNTNKHVEVNFIEKFTTERYFCPNTRCSITWFLSWSPCGECSRAITEFLSRYPHVTLFIYIARLYHHADPRNRQGLRDLISSGVTIQIMTEQESGYCWRNFVNYSPSNEAHWPRYPHLWVRLYVLELYCIILGLPPCLNILRRKQPQLTFFTIALQSCHYQRLPPHILWATGLKSGSETPGTSESATPESDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTAFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGALSRKLINGIRDKQSGKTILDFLKSDGFANRNFMALIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRAITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 340 - protein, 1300 aa, Francisella novicida
MSIYQEFVNKYSLSKTLRFELIPQGKTLENIKARGLILDDEKRAKDYKKAKQIIDKYHQFFIEEILSSVCISEDLLQNYSDVYFKLKKSDDDNLQKDFKSAKDTIKKQISEYIKDSEKFKNLFNQNLIDAKKGQESDLILWLKQSKDNGIELFKANSDITDIDEALEIIKSFKGWTTYFKGFHENRKNVYSSNDIPTSIIYRIVDDNLPKFLENKAKYESLKDKAPEAINYEQIKKDLAEELTFDIDYKTSEVNQRVFSLDEVFEIANFNNYLNQSGITKFNTIIGGKFVNGENTKRKGINEYINLYSQQINDKTLKKYKMSVLFKQILSDTESKSFVIDKLEDDSDVVTTMQSFYEQIAAFKTVEEKSIKETLSLLFDDLKAQKLDLSKIYFKNDKSLTDLSQQVFDDYSVIGTAVLEYITQQIAPKNLDNPSKKEQELIAKKTEKAKYLSLETIKLALEEFNKHRDIDKQCRFEEILANFAAIPMIFDEIAQNKDNLAQISIKYQNQGKKDLLQASAEDDVKAIKDLLDQTNNLLHKLKIFHISQSEDKANILDKDEHFYLVFEECYFELANIVPLYNKIRNYITQKPYSDEKFKLNFENSTLANGWDKNKEPDNTAILFIKDDKYYLGVMNKKNNKIFDDKAIKENKGEGYKKIVYKLLPGANKMLPKVFFSAKSIKFYNPSEDILRIRNHSTHTKNGSPQKGYEKFEFNIEDCRKFIDFYKQSISKHPEWKDFGFRFSDTQRYNSIDEFYREVENQGYKLTFENISESYIDSVVNQGKLYLFQIYNKDFSAYSKGRPNLHTLYWKALFDERNLQDVVYKLNGEAELFYRKQSIPKKITHPAKEAIANKNKDNPKKESVFEYDLIKDKRFTEDKFFFHCPITINFKSSGANKFNDEINLLLKEKANDVHILSIDRGERHLAYYTLVDGKGNIIKQDTFNIIGNDRMKTNYHDKLAAIEKDRDSARKDWKKINNIKEMKEGYLSQVVHEIAKLVIEYNAIVVFEDLNFGFKRGRFKVEKQVYQKLEKMLIEKLNYLVFKDNEFDKTGGVLRAYQLTAPFETFKKMGKQTGIIYYVPAGFTSKICPVTGFVNQLYPKYESVSKSQEFFSKFDKICYNLDKGYFEFSFDYKNFGDKAAKGKWTIASFGSRLINFRNSDKNHNWDTREVYPTKELEKLLKDYSIEYGHGECIKAAICGESDKKFFAKLTSVLNTILQMRNSKTGTELDYLISPVADVNGNFFDSRQAPKNMPQDADANGAYHIGLKGLMLLGRIKNNQEGKKLNLVIKNEEYFEFVQNRNN

SEQ ID NO: 341 - protein, 1300 aa, Francisella novicida
MSIYQEFVNKYSLSKTLRFELIPQGKTLENIKARGLILDDEKRAKDYKKAKQIIDKYHQFFIEEILSSVCISEDLLQNYSDVYFKLKKSDDDNLQKDFKSAKDTIKKQISEYIKDSEKFKNLFNQNLIDAKKGQESDLILWLKQSKDNGIELFKANSDITDIDEALEIIKSFKGWTTYFKGFHENRKNVYSSNDIPTSIIYRIVDDNLPKFLENKAKYESLKDKAPEAINYEQIKKDLAEELTFDIDYKTSEVNQRVFSLDEVFEIANFNNYLNQSGITKFNTIIGGKFVNGENTKRKGINEYINLYSQQINDKTLKKYKMSVLFKQILSDTESKSFVIDKLEDDSDVVTTMQSFYEQIAAFKTVEEKSIKETLSLLFDDLKAQKLDLSKIYFKNDKSLTDLSQQVFDDYSVIGTAVLEYITQQIAPKNLDNPSKKEQELIAKKTEKAKYLSLETIKLALEEFNKHRDIDKQCRFEEILANFAAIPMIFDEIAQNKDNLAQISIKYQNQGKKDLLQASAEDDVKAIKDLLDQTNNLLHKLKIFHISQSEDKANILDKDEHFYLVFEECYFELANIVPLYNKIRNYITQKPYSDEKFKLNFENSTLANGWDKNKEPDNTAILFIKDDKYYLGVMNKKNNKIFDDKAIKENKGEGYKKIVYKLLPGANKMLPKVFFSAKSIKFYNPSEDILRIRNHSTHTKNGSPQKGYEKFEFNIEDCRKFIDFYKQSISKHPEWKDFGFRFSDTQRYNSIDEFYREVENQGYKLTFENISESYIDSVVNQGKLYLFQIYNKDFSAYSKGRPNLHTLYWKALFDERNLQDVVYKLNGEAELFYRKQSIPKKITHPAKEAIANKNKDNPKKESVFEYDLIKDKRFTEDKFFFHCPITINFKSSGANKFNDEINLLLKEKANDVHILSIARGERHLAYYTLVDGKGNIIKQDTFNIIGNDRMKTNYHDKLAAIEKDRDSARKDWKKINNIKEMKEGYLSQVVHEIAKLVIEYNAIVVFEDLNFGFKRGRFKVEKQVYQKLEKMLIEKLNYLVFKDNEFDKTGGVLRAYQLTAPFETFKKMGKQTGIIYYVPAGFTSKICPVTGFVNQLYPKYESVSKSQEFFSKFDKICYNLDKGYFEFSFDYKNFGDKAAKGKWTIASFGSRLINFRNSDKNHNWDTREVYPTKELEKLLKDYSIEYGHGECIKAAICGESDKKFFAKLTSVLNTILQMRNSKTGTELDYLISPVADVNGNFFDSRQAPKNMPQDADANGAYHIGLKGLMLLGRIKNNQEGKKLNLVIKNEEYFEFVQNRNN

SEQ ID NO: 342 - protein, 1300 aa, Francisella novicida
MSIYQEFVNKYSLSKTLRFELIPQGKTLENIKARGLILDDEKRAKDYKKAKQIIDKYHQFFIEEILSSVCISEDLLQNYSDVYFKLKKSDDDNLQKDFKSAKDTIKKQISEYIKDSEKFKNLFNQNLIDAKKGQESDLILWLKQSKDNGIELFKANSDITDIDEALEIIKSFKGWTTYFKGFHENRKNVYSSNDIPTSIIYRIVDDNLPKFLENKAKYESLKDKAPEAINYEQIKKDLAEELTFDIDYKTSEVNQRVFSLDEVFEIANFNNYLNQSGITKFNTIIGGKFVNGENTKRKGINEYINLYSQQINDKTLKKYKMSVLFKQILSDTESKSFVIDKLEDDSDVVTTMQSFYEQIAAFKTVEEKSIKETLSLLFDDLKAQKLDLSKIYFKNDKSLTDLSQQVFDDYSVIGTAVLEYITQQIAPKNLDNPSKKEQELIAKKTEKAKYLSLETIKLALEEFNKHRDIDKQCRFEEILANFAAIPMIFDEIAQNKDNLAQISIKYQNQGKKDLLQASAEDDVKAIKDLLDQTNNLLHKLKIFHISQSEDKANILDKDEHFYLVFEECYFELANIVPLYNKIRNYITQKPYSDEKFKLNFENSTLANGWDKNKEPDNTAILFIKDDKYYLGVMNKKNNKIFDDKAIKENKGEGYKKIVYKLLPGANKMLPKVFFSAKSIKFYNPSEDILRIRNHSTHTKNGSPQKGYEKFEFNIEDCRKFIDFYKQSISKHPEWKDFGFRFSDTQRYNSIDEFYREVENQGYKLTFENISESYIDSVVNQGKLYLFQIYNKDFSAYSKGRPNLHTLYWKALFDERNLQDVVYKLNGEAELFYRKQSIPKKITHPAKEAIANKNKDNPKKESVFEYDLIKDKRFTEDKFFFHCPITINFKSSGANKFNDEINLLLKEKANDVHILSIDRGERHLAYYTLVDGKGNIIKQDTFNIIGNDRMKTNYHDKLAAIEKDRDSARKDWKKINNIKEMKEGYLSQVVHEIAKLVIEYNAIVVFADLNFGFKRGRFKVEKQVYQKLEKMLIEKLNYLVFKDNEFDKTGGVLRAYQLTAPFETFKKMGKQTGIIYYVPAGFTSKICPVTGFVNQLYPKYESVSKSQEFFSKFDKICYNLDKGYFEFSFDYKNFGDKAAKGKWTIASFGSRLINFRNSDKNHNWDTREVYPTKELEKLLKDYSIEYGHGECIKAAICGESDKKFFAKLTSVLNTILQMRNSKTGTELDYLISPVADVNGNFFDSRQAPKNMPQDADANGAYHIGLKGLMLLGRIKNNQEGKKLNLVIKNEEYFEFVQNRNN

SEQ ID NO: 343 - protein, 1300 aa, Francisella novicida
MSIYQEFVNKYSLSKTLRFELIPQGKTLENIKARGLILDDEKRAKDYKKAKQIIDKYHQFFIEEILSSVCISEDLLQNYSDVYFKLKKSDDDNLQKDFKSAKDTIKKQISEYIKDSEKFKNLFNQNLIDAKKGQESDLILWLKQSKDNGIELFKANSDITDIDEALEIIKSFKGWTTYFKGFHENRKNVYSSNDIPTSIIYRIVDDNLPKFLENKAKYESLKDKAPEAINYEQIKKDLAEELTFDIDYKTSEVNQRVFSLDEVFEIANFNNYLNQSGITKFNTIIGGKFVNGENTKRKGINEYINLYSQQINDKTLKKYKMSVLFKQILSDTESKSFVIDKLEDDSDVVTTMQSFYEQIAAFKTVEEKSIKETLSLLFDDLKAQKLDLSKIYFKNDKSLTDLSQQVFDDYSVIGTAVLEYITQQIAPKNLDNPSKKEQELIAKKTEKAKYLSLETIKLALEEFNKHRDIDKQCRFEEILANFAAIPMIFDEIAQNKDNLAQISIKYQNQGKKDLLQASAEDDVKAIKDLLDQTNNLLHKLKIFHISQSEDKANILDKDEHFYLVFEECYFELANIVPLYNKIRNYITQKPYSDEKFKLNFENSTLANGWDKNKEPDNTAILFIKDDKYYLGVMNKKNNKIFDDKAIKENKGEGYKKIVYKLLPGANKMLPKVFFSAKSIKFYNPSEDILRIRNHSTHTKNGSPQKGYEKFEFNIEDCRKFIDFYKQSISKHPEWKDFGFRFSDTQRYNSIDEFYREVENQGYKLTFENISESYIDSVVNQGKLYLFQIYNKDFSAYSKGRPNLHTLYWKALFDERNLQDVVYKLNGEAELFYRKQSIPKKITHPAKEAIANKNKDNPKKESVFEYDLIKDKRFTEDKFFFHCPITINFKSSGANKFNDEINLLLKEKANDVHILSIDRGERHLAYYTLVDGKGNIIKQDTFNIIGNDRMKTNYHDKLAAIEKDRDSARKDWKKINNIKEMKEGYLSQVVHEIAKLVIEYNAIVVFEDLNFGFKRGRFKVEKQVYQKLEKMLIEKLNYLVFKDNEFDKTGGVLRAYQLTAPFETFKKMGKQTGIIYYVPAGFTSKICPVTGFVNQLYPKYESVSKSQEFFSKFDKICYNLDKGYFEFSFDYKNFGDKAAKGKWTIASFGSRLINFRNSDKNHNWDTREVYPTKELEKLLKDYSIEYGHGECIKAAICGESDKKFFAKLTSVLNTILQMRNSKTGTELDYLISPVADVNGNFFDSRQAPKNMPQDAAANGAYHIGLKGLMLLGRIKNNQEGKKLNLVIKNEEYFEFVQNRNN

SEQ ID NO: 344 - protein, 1300 aa, Francisella novicida
MSIYQEFVNKYSLSKTLRFELIPQGKTLENIKARGLILDDEKRAKDYKKAKQIIDKYHQFFIEEILSSVCISEDLLQNYSDVYFKLKKSDDDNLQKDFKSAKDTIKKQISEYIKDSEKFKNLFNQNLIDAKKGQESDLILWLKQSKDNGIELFKANSDITDIDEALEIIKSFKGWTTYFKGFHENRKNVYSSNDIPTSIIYRIVDDNLPKFLENKAKYESLKDKAPEAINYEQIKKDLAEELTFDIDYKTSEVNQRVFSLDEVFEIANFNNYLNQSGITKFNTIIGGKFVNGENTKRKGINEYINLYSQQINDKTLKKYKMSVLFKQILSDTESKSFVIDKLEDDSDVVTTMQSFYEQIAAFKTVEEKSIKETLSLLFDDLKAQKLDLSKIYFKNDKSLTDLSQQVFDDYSVIGTAVLEYITQQIAPKNLDNPSKKEQELIAKKTEKAKYLSLETIKLALEEFNKHRDIDKQCRFEEILANFAAIPMIFDEIAQNKDNLAQISIKYQNQGKKDLLQASAEDDVKAIKDLLDQTNNLLHKLKIFHISQSEDKANILDKDEHFYLVFEECYFELANIVPLYNKIRNYITQKPYSDEKFKLNFENSTLANGWDKNKEPDNTAILFIKDDKYYLGVMNKKNNKIFDDKAIKENKGEGYKKIVYKLLPGANKMLPKVFFSAKSIKFYNPSEDILRIRNHSTHTKNGSPQKGYEKFEFNIEDCRKFIDFYKQSISKHPEWKDFGFRFSDTQRYNSIDEFYREVENQGYKLTFENISESYIDSVVNQGKLYLFQIYNKDFSAYSKGRPNLHTLYWKALFDERNLQDVVYKLNGEAELFYRKQSIPKKITHPAKEAIANKNKDNPKKESVFEYDLIKDKRFTEDKFFFHCPITINFKSSGANKFNDEINLLLKEKANDVHILSIARGERHLAYYTLVDGKGNIIKQDTFNIIGNDRMKTNYHDKLAAIEKDRDSARKDWKKINNIKEMKEGYLSQVVHEIAKLVIEYNAIVVFADLNFGFKRGRFKVEKQVYQKLEKMLIEKLNYLVFKDNEFDKTGGVLRAYQLTAPFETFKKMGKQTGIIYYVPAGFTSKICPVTGFVNQLYPKYESVSKSQEFFSKFDKICYNLDKGYFEFSFDYKNFGDKAAKGKWTIASFGSRLINFRNSDKNHNWDTREVYPTKELEKLLKDYSIEYGHGECIKAAICGESDKKFFAKLTSVLNTILQMRNSKTGTELDYLISPVADVNGNFFDSRQAPKNMPQDADANGAYHIGLKGLMLLGRIKNNQEGKKLNLVIKNEEYFEFVQNRNN

SEQ ID NO: 345 - protein, 1300 aa, Francisella novicida
MSIYQEFVNKYSLSKTLRFELIPQGKTLENIKARGLILDDEKRAKDYKKAKQIIDKYHQFFIEEILSSVCISEDLLQNYSDVYFKLKKSDDDNLQKDFKSAKDTIKKQISEYIKDSEKFKNLFNQNLIDAKKGQESDLILWLKQSKDNGIELFKANSDITDIDEALEIIKSFKGWTTYFKGFHENRKNVYSSNDIPTSIIYRIVDDNLPKFLENKAKYESLKDKAPEAINYEQIKKDLAEELTFDIDYKTSEVNQRVFSLDEVFEIANFNNYLNQSGITKFNTIIGGKFVNGENTKRKGINEYINLYSQQINDKTLKKYKMSVLFKQILSDTESKSFVIDKLEDDSDVVTTMQSFYEQIAAFKTVEEKSIKETLSLLFDDLKAQKLDLSKIYFKNDKSLTDLSQQVFDDYSVIGTAVLEYITQQIAPKNLDNPSKKEQELIAKKTEKAKYLSLETIKLALEEFNKHRDIDKQCRFEEILANFAAIPMIFDEIAQNKDNLAQISIKYQNQGKKDLLQASAEDDVKAIKDLLDQTNNLLHKLKIFHISQSEDKANILDKDEHFYLVFEECYFELANIVPLYNKIRNYITQKPYSDEKFKLNFENSTLANGWDKNKEPDNTAILFIKDDKYYLGVMNKKNNKIFDDKAIKENKGEGYKKIVYKLLPGANKMLPKVFFSAKSIKFYNPSEDILRIRNHSTHTKNGSPQKGYEKFEFNIEDCRKFIDFYKQSISKHPEWKDFGFRFSDTQRYNSIDEFYREVENQGYKLTFENISESYIDSVVNQGKLYLFQIYNKDFSAYSKGRPNLHTLYWKALFDERNLQDVVYKLNGEAELFYRKQSIPKKITHPAKEAIANKNKDNPKKESVFEYDLIKDKRFTEDKFFFHCPITINFKSSGANKFNDEINLLLKEKANDVHILSIARGERHLAYYTLVDGKGNIIKQDTFNIIGNDRMKTNYHDKLAAIEKDRDSARKDWKKINNIKEMKEGYLSQVVHEIAKLVIEYNAIVVFEDLNFGFKRGRFKVEKQVYQKLEKMLIEKLNYLVFKDNEFDKTGGVLRAYQLTAPFETFKKMGKQTGIIYYVPAGFTSKICPVTGFVNQLYPKYESVSKSQEFFSKFDKICYNLDKGYFEFSFDYKNFGDKAAKGKWTIASFGSRLINFRNSDKNHNWDTREVYPTKELEKLLKDYSIEYGHGECIKAAICGESDKKFFAKLTSVLNTILQMRNSKTGTELDYLISPVADVNGNFFDSRQAPKNMPQDAAANGAYHIGLKGLMLLGRIKNNQEGKKLNLVIKNEEYFEFVQNRNN

SEQ ID NO: 346 - protein, 1300 aa, Francisella novicida
MSIYQEFVNKYSLSKTLRFELIPQGKTLENIKARGLILDDEKRAKDYKKAKQIIDKYHQFFIEEILSSVCISEDLLQNYSDVYFKLKKSDDDNLQKDFKSAKDTIKKQISEYIKDSEKFKNLFNQNLIDAKKGQESDLILWLKQSKDNGIELFKANSDITDIDEALEIIKSFKGWTTYFKGFHENRKNVYSSNDIPTSIIYRIVDDNLPKFLENKAKYESLKDKAPEAINYEQIKKDLAEELTFDIDYKTSEVNQRVFSLDEVFEIANFNNYLNQSGITKFNTIIGGKFVNGENTKRKGINEYINLYSQQINDKTLKKYKMSVLFKQILSDTESKSFVIDKLEDDSDVVTTMQSFYEQIAAFKTVEEKSIKETLSLLFDDLKAQKLDLSKIYFKNDKSLTDLSQQVFDDYSVIGTAVLEYITQQIAPKNLDNPSKKEQELIAKKTEKAKYLSLETIKLALEEFNKHRDIDKQCRFEEILANFAAIPMIFDEIAQNKDNLAQISIKYQNQGKKDLLQASAEDDVKAIKDLLDQTNNLLHKLKIFHISQSEDKANILDKDEHFYLVFEECYFELANIVPLYNKIRNYITQKPYSDEKFKLNFENSTLANGWDKNKEPDNTAILFIKDDKYYLGVMNKKNNKIFDDKAIKENKGEGYKKIVYKLLPGANKMLPKVFFSAKSIKFYNPSEDILRIRNHSTHTKNGSPQKGYEKFEFNIEDCRKFIDFYKQSISKHPEWKDFGFRFSDTQRYNSIDEFYREVENQGYKLTFENISESYIDSVVNQGKLYLFQIYNKDFSAYSKGRPNLHTLYWKALFDERNLQDVVYKLNGEAELFYRKQSIPKKITHPAKEAIANKNKDNPKKESVFEYDLIKDKRFTEDKFFFHCPITINFKSSGANKFNDEINLLLKEKANDVHILSIDRGERHLAYYTLVDGKGNIIKQDTFNIIGNDRMKTNYHDKLAAIEKDRDSARKDWKKINNIKEMKEGYLSQVVHEIAKLVIEYNAIVVFADLNFGFKRGRFKVEKQVYQKLEKMLIEKLNYLVFKDNEFDKTGGVLRAYQLTAPFETFKKMGKQTGIIYYVPAGFTSKICPVTGFVNQLYPKYESVSKSQEFFSKFDKICYNLDKGYFEFSFDYKNFGDKAAKGKWTIASFGSRLINFRNSDKNHNWDTREVYPTKELEKLLKDYSIEYGHGECIKAAICGESDKKFFAKLTSVLNTILQMRNSKTGTELDYLISPVADVNGNFFDSRQAPKNMPQDAAANGAYHIGLKGLMLLGRIKNNQEGKKLNLVIKNEEYFEFVQNRNN

SEQ ID NO: 347 - protein, 1300 aa, Francisella novicida
MSIYQEFVNKYSLSKTLRFELIPQGKTLENIKARGLILDDEKRAKDYKKAKQIIDKYHQFFIEEILSSVCISEDLLQNYSDVYFKLKKSDDDNLQKDFKSAKDTIKKQISEYIKDSEKFKNLFNQNLIDAKKGQESDLILWLKQSKDNGIELFKANSDITDIDEALEIIKSFKGWTTYFKGFHENRKNVYSSNDIPTSIIYRIVDDNLPKFLENKAKYESLKDKAPEAINYEQIKKDLAEELTFDIDYKTSEVNQRVFSLDEVFEIANFNNYLNQSGITKFNTIIGGKFVNGENTKRKGINEYINLYSQQINDKTLKKYKMSVLFKQILSDTESKSFVIDKLEDDSDVVTTMQSFYEQIAAFKTVEEKSIKETLSLLFDDLKAQKLDLSKIYFKNDKSLTDLSQQVFDDYSVIGTAVLEYITQQIAPKNLDNPSKKEQELIAKKTEKAKYLSLETIKLALEEFNKHRDIDKQCRFEEILANFAAIPMIFDEIAQNKDNLAQISIKYQNQGKKDLLQASAEDDVKAIKDLLDQTNNLLHKLKIFHISQSEDKANILDKDEHFYLVFEECYFELANIVPLYNKIRNYITQKPYSDEKFKLNFENSTLANGWDKNKEPDNTAILFIKDDKYYLGVMNKKNNKIFDDKAIKENKGEGYKKIVYKLLPGANKMLPKVFFSAKSIKFYNPSEDILRIRNHSTHTKNGSPQKGYEKFEFNIEDCRKFIDFYKQSISKHPEWKDFGFRFSDTQRYNSIDEFYREVENQGYKLTFENISESYIDSVVNQGKLYLFQIYNKDFSAYSKGRPNLHTLYWKALFDERNLQDVVYKLNGEAELFYRKQSIPKKITHPAKEAIANKNKDNPKKESVFEYDLIKDKRFTEDKFFFHCPITINFKSSGANKFNDEINLLLKEKANDVHILSIARGERHLAYYTLVDGKGNIIKQDTFNIIGNDRMKTNYHDKLAAIEKDRDSARKDWKKINNIKEMKEGYLSQVVHEIAKLVIEYNAIVVFADLNFGFKRGRFKVEKQVYQKLEKMLIEKLNYLVFKDNEFDKTGGVLRAYQLTAPFETFKKMGKQTGIIYYVPAGFTSKICPVTGFVNQLYPKYESVSKSQEFFSKFDKICYNLDKGYFEFSFDYKNFGDKAAKGKWTIASFGSRLINFRNSDKNHNWDTREVYPTKELEKLLKDYSIEYGHGECIKAAICGESDKKFFAKLTSVLNTILQMRNSKTGTELDYLISPVADVNGNFFDSRQAPKNMPQDAAANGAYHIGLKGLMLLGRIKNNQEGKKLNLVIKNEEYFEFVQNRNN

SEQ ID NO: 348 - protein, 887 aa, Natronobacterium gregoryi
MTVIDLDSTTTADELTSGHTYDISVTLTGVYDNTDEQHPRMSLAFEQDNGERRYITLWKNTTPKDVFTYDYATGSTYIFTNIDYEVKDGYENLTATYQTTVENATAQEVGTTDEDETFAGGEPLDHHLDDALNETPDDAETESDSGHVMTSFASRDQLPEWTLHTYTLTATDGAKTDTEYARRTLAYTVRQELYTDHDAAPVATDGLMLLTPEPLGETPLDLDCGVRVEADETRTLDYTTAKDRLLARELVEEGLKRSLWDDYLVRGIDEVLSKEPVLTCDEFDLHERYDLSVEVGHSGRAYLHINFRHRFVPKLTLADIDDDNIYPGLRVKTTYRPRRGHIVWGLRDECATDSLNTLGNQSVVAYHRNNQTPINTDLLDAIEAADRRVVETRRQGHGDDAVSFPQELLAVEPNTHQIKQFASDGFHQQARSKTRLSASRCSEKAQAFAERLDPVRLNGSTVEFSSEFFTGNNEQQLRLLYENGESVLTFRDGARGAHPDETFSKGIVNPPESFEVAVVLPEQQADTCKAQWDTMADLLNQAGAPPTRSETVQYDAFSSPESISLNVAGAIDPSEVDAAFVVLPPDQEGFADLASPTETYDELKKALANMGIYSQMAYFDRFRDAKIFYTRNVALGLLAAAGGVAFTTEHAMPGDADMFIGIDVSRSYPEDGASGQINIAATATAVYKDGTILGHSSTRPQLGEKLQSTDVRDIMKNAILGYQQVTGESPTHIVIHRDGFMNEDLDPATEFLNEQGVEYDIVEIRKQPQTRLLAVSDVQYDTPVKSIAAINQNEPRATVATFGAPEYLATRDGGGLPRPIQIERVAGETDIETLTRQVYLLSQSHIQVHNSTARLPITTAYADQASTHATKGYLVQTGAFESNVGFL

SEQ ID NO: 349 - protein, 4 aa, Artificial Sequence
  Synthetic Polypeptide
ALAL

SEQ ID NO: 350 - protein, 15 aa, Artificial Sequence
  Synthetic Polypeptide
VPFLLEPDNINGKTC

SEQ ID NO: 351 - protein, 12 aa, Artificial Sequence
  Synthetic Polypeptide
GSAGSAAGSGEF

SEQ ID NO: 352 - protein, 12 aa, Artificial Sequence
  Synthetic Polypeptide
SIVAQLSRPDPA

SEQ ID NO: 353 - protein, 10 aa, Artificial Sequence
  Synthetic Polypeptide
MKIIEQLPSA

SEQ ID NO: 354 - protein, 10 aa, Artificial Sequence
  Synthetic Polypeptide
VRHKLKRVGS

SEQ ID NO: 355 - protein, 12 aa, Artificial Sequence
  Synthetic Polypeptide
GHGTGSTGSGSS

SEQ ID NO: 356 - protein, 7 aa, Artificial Sequence
  Synthetic Polypeptide
MSRPDPA

SEQ ID NO: 357 - protein, 12 aa, Artificial Sequence
  Synthetic Polypeptide
GSAGSAAGSGEF

SEQ ID NO: 358 - protein, 12 aa, Artificial Sequence
  Synthetic Polypeptide
SGSETPGTSESA

SEQ ID NO: 359 - protein, 21 aa, Artificial Sequence
  Synthetic Polypeptide
SGSETPGTSESATPEGGSGGS

SEQ ID NO: 360 - protein, 4 aa, Artificial Sequence
  Synthetic Polypeptide
GGSM

SEQ ID NO: 361 - protein, 84 aa, Bacillus phage PBS2
MTNLSDIIEKETGKQLVIQESILMLPEEVEEVIGNKPESDILVHTAYDESTDENVMLLTSDAPEYKPWALVIQDSNGENKIKML

SEQ ID NO: 362 - protein, 181 aa, Erwinia tasmaniensis
MASRGVNKVILVGNLGQDPEVRYMPNGGAVANITLATSESWRDKQTGETKEKTEWHRVVLFGKLAEVAGEYLRKGSQVYIEGALQTRKWTDQAGVEKYTTEVVVNVGGTMQMLGGRSQGGGASAGGQNGGSNNGWGQPQQPQGGNQFSGGAQQQARPQQQPQQNNAPANNEPPIDFDDDIP

SEQ ID NO: 363 - protein, 209 aa, Artificial Sequence
  Synthetic Polypeptide
MAGAQDFVPHTADLAELAAAAGECRGCGLYRDATQAVFGAGGRSARIMMIGEQPGDKEDLAGLPFVGPAGRLLDRALEAADIDRDALYVTNAVKHFKFTRAAGGKRRIHKTPSRTEVVACRPWLIAEMTSVEPDVVVLLGATAAKALLGNDFRVTQHRGEVLHVDDVPGDPALVATVHPSSLLRGPKEERESAFAGLVDDLRVAADVRP

SEQ ID NO: 364 - protein, 313 aa, Artificial Sequence
  Synthetic Polypeptide
MIGQKTLYSFFSPSPARKRHAPSPEPAVQGTGVAGVPEESGDAAAIPAKKAPAGQEEPGTPPSSPLSAEQLDRIQRNKAAALLRLAARNVPVGFGESWKKHLSGEFGKPYFIKLMGFVAEERKHYTVYPPPHQVFTWTQMCDIKDVKVVILGQEPYHGPNQAHGLCFSVQRPVPPPPSLENIYKELSTDIEDFVHPGHGDLSGWAKQGVLLLNAVLTVRAHQANSHKERGWEQFTDAVVSWLNQNSNGLVFLLWGSYAQKKGSAIDRKRHHVLQTAHPSPLSVYRGFFGCRHFSKTNELLQKSGKKPIDWKEL

SEQ ID NO: 365 - protein, 7 aa, Artificial Sequence
  Synthetic Polypeptide
PKKKRKV

SEQ ID NO: 366 - protein, 30 aa, Artificial Sequence
  Synthetic Polypeptide
MDSLLMNRRKFLYQFKNVRWAKGRRETYLC

SEQ ID NO: 367 - RNA, 74 nt, C. jejuni
aagaaauuuaaaaagggacuaaaauaaagaguuugcgggacucugcgggguuacaauccccuaaaaccgcuuuu

SEQ ID NO: 368 - RNA, 95 nt, F. novicida
aucuaaaauuauaaauguaccaaauaauuaaugcucuguaaucauuuaaaaguauuuugaacggaccucuguuugacacgucugaauaacuaaaa

SEQ ID NO: 369 - RNA, 109 nt, S. thermophilus2
uguaagggacgccuuacacaguuacuuaaaucuugcagaagcuacaaagauaaggcuucaugccgaaaucaacacccugucauuuuauggcaggguguuuucguuauuu

SEQ ID NO: 370 - RNA, 110 nt, M. mobile
uguauuucgaaauacagauguacaguuaagaauacauaagaaugauacaucacuaaaaaaaggcuuuaugccguaacuacuacuuauuuucaaaauaaguaguuuuuuuu

SEQ ID NO: 371 - RNA, 92 nt, L. innocua
auuguuaguauucaaaauaacauagcaaguuaaaauaaggcuuuguccguuaucaacuuuuaauuaaguagcgcuguuucggcgcuuuuuuu

SEQ ID NO: 372 - RNA, 89 nt, S. pyogenes
guuggaaccauucaaaacagcauagcaaguuaaaauaaggcuaguccguuaucaacuugaaaaaguggcaccgagucggugcuuuuuuu

SEQ ID NO: 373 - RNA, 107 nt, S. mutans
guuggaaucauucgaaacaacacagcaaguuaaaauaaggcagugauuuuuaauccaguccguacacaacuugaaaaagugcgcaccgauucggugcuuuuuuauuu

SEQ ID NO: 374 - RNA, 96 nt, S. thermophilus
uugugguuugaaaccauucgaaacaacacagcgaguuaaaauaaggcuuaguccguacucaacuugaaaagguggcaccgauucgguguuuuuuuu

SEQ ID NO: 375 - RNA, 102 nt, N. meningitidis
acauauugucgcacugcgaaaugagaaccguugcuacaauaaggccgucugaaaagaugugccgcaacgcucugccccuuaaagcuucugcuuuaaggggca

SEQ ID NO: 376 - RNA, 110 nt, P. multocida
gcauauuguugcacugcgaaaugagagacguugcuacaauaaggcuucugaaaagaaugaccguaacgcucugccccuugugauucuuaauugcaaggggcaucguuuuu

SEQ ID NO: 377 - RNA, 93 nt, S. pyogenes
guuuaagagcuaugcuggaaagccacggugaaaaaguucaacuauugccugaucggaauaaauuugaacgauacgacagucggugcuuuuuuu

SEQ ID NO: 378 - RNA, 82 nt, S. pyogenes
guuuaagagcuagaaauagcaaguuuaaauaaggcuaguccguuaucaacuugaaaaaguggcaccgagucggugcuuuuuu

SEQ ID NO: 379 - RNA, 97 nt, S. thermophilus
guuuuuguacucucaagauucaauaaucuugcagaagcuacaaagauaaggcuucaugccgaaaucaacacccugucauuuuauggcaggguguuuu

SEQ ID NO: 380 - RNA, 97 nt, S. thermophilus
guuuuagagcuguguuguuuguuaaaacaacacagcgaguuaaaauaaggcuuaguccguacucaacuugaaaagguggcaccgauucgguguuuuu

SEQ ID NO: 381 - RNA, 20 nt, Artificial Sequence
  Synthetic Polynucleotide
uaauccaucuuguuccaccc

SEQ ID NO: 382 - RNA, 21 nt, Artificial Sequence
  Synthetic Polynucleotide
ccaucuuguuccacccugugc

SEQ ID NO: 383 - RNA, 20 nt, Artificial Sequence
  Synthetic Polynucleotide
cagggcuccgauguauaaua

SEQ ID NO: 384 - RNA, 20 nt, Artificial Sequence
  Synthetic Polynucleotide
uuggcagggcuccgauguau

SEQ ID NO: 385 - RNA, 20 nt, Artificial Sequence
  Synthetic Polynucleotide
guugacacauuguauuucca

SEQ ID NO: 386 - RNA, 20 nt, Artificial Sequence
  Synthetic Polynucleotide
gaguugacacauuguauuuc

SEQ ID NO: 387 - RNA, 20 nt, Artificial Sequence
  Synthetic Polynucleotide
auaaaauagagcccugucaa

SEQ ID NO: 388 - RNA, 20 nt, Artificial Sequence
  Synthetic Polynucleotide
ugagagcugcagguguaaug

SEQ ID NO: 389 - RNA, 20 nt, Artificial Sequence
  Synthetic Polynucleotide
gagagcugcagguguaauga

SEQ ID NO: 390 - RNA, 20 nt, Artificial Sequence
  Synthetic Polynucleotide
cgacaccgaagcagaguuuu

SEQ ID NO: 391 - RNA, 20 nt, Artificial Sequence
  Synthetic Polynucleotide
gacaccgaagcagaguuuuu

SEQ ID NO: 392 - RNA, 20 nt, Artificial Sequence
  Synthetic Polynucleotide
acaccgaagcagaguuuuua

SEQ ID NO: 393 - RNA, 20 nt, Artificial Sequence
  Synthetic Polynucleotide
cgacaccgaagcagaguuuu

SEQ ID NO: 394 - RNA, 22 nt, Artificial Sequence
  Synthetic Polynucleotide
cgaagcagaguuuuuaggauuc

SEQ ID NO: 395 - RNA, 20 nt, Artificial Sequence
  Synthetic Polynucleotide
uacugcaauuauucaggcca

SEQ ID NO: 396 - RNA, 20 nt, Artificial Sequence
  Synthetic Polynucleotide
acugcaauuauucaggccaa

SEQ ID NO: 397 - RNA, 20 nt, Artificial Sequence
  Synthetic Polynucleotide
uacugcaauuauucaggcca

SEQ ID NO: 398 - RNA, 20 nt, Artificial Sequence
  Synthetic Polynucleotide
ccacccugugcauaaauaaa

SEQ ID NO: 399 - RNA, 20 nt, Artificial Sequence
  Synthetic Polynucleotide
cccugugcauaaauaaaaag

SEQ ID NO: 400 - RNA, 20 nt, Artificial Sequence
  Synthetic Polynucleotide
cacccugugcauaaauaaaa

SEQ ID NO: 401 - RNA, 20 nt, Artificial Sequence
  Synthetic Polynucleotide
cacccugugcauaaauaaaa

SEQ ID NO: 402 - RNA, 30 nt, Artificial Sequence
  Synthetic Polynucleotide
uuccacccugugcauaaauauuuaugcaca

SEQ ID NO: 403 - RNA, 10 nt, Artificial Sequence
  Synthetic Polynucleotide
ggguggaaca

SEQ ID NO: 404 - RNA, 20 nt, Artificial Sequence
  Synthetic Polynucleotide
ugcacaggguggaacaagau

SEQ ID NO: 405 - RNA, 20 nt, Artificial Sequence
  Synthetic Polynucleotide
auuuaugcacaggguggaac

SEQ ID NO: 406 - RNA, 20 nt, Artificial Sequence
  Synthetic Polynucleotide
augcacaggguggaacaaga

SEQ ID NO: 407 - RNA, 20 nt, Artificial Sequence
  Synthetic Polynucleotide
gagggcaacuaaauacauuc

SEQ ID NO: 408 - RNA, 20 nt, Artificial Sequence
  Synthetic Polynucleotide
agggcaacuaaauacauucu

SEQ ID NO: 409 - RNA, 20 nt, Artificial Sequence
  Synthetic Polynucleotide
aaacuguuuuauacaucaau

SEQ ID NO: 410 - RNA, 20 nt, Artificial Sequence
  Synthetic Polynucleotide
caaacuguuuuauacaucaa

SEQ ID NO: 411 - RNA, 21 nt, Artificial Sequence
  Synthetic Polynucleotide
cccugccaaaaaaucaaugug

SEQ ID NO: 412 - RNA, 20 nt, Artificial Sequence
  Synthetic Polynucleotide
ccugccaaaaaaucaaugug

SEQ ID NO: 413 - RNA, 20 nt, Artificial Sequence
  Synthetic Polynucleotide
gagcccugccaaaaaaucaa

SEQ ID NO: 414 - RNA, 20 nt, Artificial Sequence
  Synthetic Polynucleotide
gcccugccaaaaaaucaaug

SEQ ID NO: 415 - RNA, 20 nt, Artificial Sequence
  Synthetic Polynucleotide
uauacaucggagcccugcca

SEQ ID NO: 416 - RNA, 20 nt, Artificial Sequence
  Synthetic Polynucleotide
caucggagcccugccaaaaa

SEQ ID NO: 417 - RNA, 20 nt, Artificial Sequence
  Synthetic Polynucleotide
ccugccuccgcucuacucac

SEQ ID NO: 418 - RNA, 20 nt, Artificial Sequence
  Synthetic Polynucleotide
cugccuccgcucuacucacu

SEQ ID NO: 419 - RNA, 20 nt, Artificial Sequence
  Synthetic Polynucleotide
cuccugccuccgcucuacuc

SEQ ID NO: 420 - RNA, 20 nt, Artificial Sequence
  Synthetic Polynucleotide
aaccaaagaugaacaccagu

SEQ ID NO: 421 - RNA, 20 nt, Artificial Sequence
  Synthetic Polynucleotide
caaaaccaaagaugaacacc

SEQ ID NO: 422 - RNA, 20 nt, Artificial Sequence
  Synthetic Polynucleotide
acaaaaccaaagaugaacac

SEQ ID NO: 423 - RNA, 20 nt, Artificial Sequence
  Synthetic Polynucleotide
aaaaccaaagaugaacacca

SEQ ID NO: 424 - RNA, 20 nt, Artificial Sequence
  Synthetic Polynucleotide
ccacaaaaccaaagaugaac

SEQ ID NO: 425 - RNA, 20 nt, Artificial Sequence
  Synthetic Polynucleotide
gcauguugcccacaaaacca

SEQ ID NO: 426 - RNA, 20 nt, Artificial Sequence
  Synthetic Polynucleotide
guugcccacaaaaccaaaga

SEQ ID NO: 427 - RNA, 20 nt, Artificial Sequence
  Synthetic Polynucleotide
cauguugcccacaaaaccaa

SEQ ID NO: 428 - RNA, 20 nt, Artificial Sequence
  Synthetic Polynucleotide
agcauguugcccacaaaacc

SEQ ID NO: 429 - RNA, 20 nt, Artificial Sequence
  Synthetic Polynucleotide
gagaagaagccuauaaaaua

SEQ ID NO: 430 - RNA, 20 nt, Artificial Sequence
  Synthetic Polynucleotide
cagagaagaagccuauaaaa

SEQ ID NO: 431 - RNA, 29 nt, Artificial Sequence
  Synthetic Polynucleotide
ccagagaagaagccuauaaaaugaagaag

SEQ ID NO: 432 - RNA, 12 nt, Artificial Sequence
  Synthetic Polynucleotide
auuccagagaag

SEQ ID NO: 433 - RNA, 20 nt, Artificial Sequence
  Synthetic Polynucleotide
gauuccagagaagaagccua

SEQ ID NO: 434 - RNA, 20 nt, Artificial Sequence
  Synthetic Polynucleotide
caccccaaaggugaccgucc

SEQ ID NO: 435 - RNA, 20 nt, Artificial Sequence
  Synthetic Polynucleotide
cacacuugucaccaccccaa

SEQ ID NO: 436 - RNA, 20 nt, Artificial Sequence
  Synthetic Polynucleotide
ucacacuugucaccacccca

SEQ ID NO: 437 - RNA, 20 nt, Artificial Sequence
  Synthetic Polynucleotide
acuugucaccaccccaaagg

SEQ ID NO: 438 - RNA, 20 nt, Artificial Sequence
  Synthetic Polynucleotide
acacuugucaccaccccaaa

SEQ ID NO: 439 - RNA, 20 nt, Artificial Sequence
  Synthetic Polynucleotide
aucacacuugucaccacccc

SEQ ID NO: 440 - RNA, 20 nt, Artificial Sequence
  Synthetic Polynucleotide
cucccaggaaucaucuuuac

SEQ ID NO: 441 - RNA, 20 nt, Artificial Sequence
  Synthetic Polynucleotide
ucccaggaaucaucuuuacc

SEQ ID NO: 442 - RNA, 20 nt, Artificial Sequence
  Synthetic Polynucleotide
ucucccaggaaucaucuuua

SEQ ID NO: 443 - RNA, 20 nt, Artificial Sequence
  Synthetic Polynucleotide
uccugggagagacgcaaaca

SEQ ID NO: 444 - RNA, 20 nt, Artificial Sequence
  Synthetic Polynucleotide
guaaagaugauuccugggag

SEQ ID NO: 445 - RNA, 21 nt, Artificial Sequence
  Synthetic Polynucleotide
ccauacagucaguaucaauuc

SEQ ID NO: 446 - RNA, 20 nt, Artificial Sequence
  Synthetic Polynucleotide
cauacagucaguaucaauuc

SEQ ID NO: 447 - RNA, 20 nt, Artificial Sequence
  Synthetic Polynucleotide
gcucucauuuuccauacagu

SEQ ID NO: 448 - RNA, 20 nt, Artificial Sequence
  Synthetic Polynucleotide
ucauuuuccauacagucagu

SEQ ID NO: 449 - RNA, 20 nt, Artificial Sequence
  Synthetic Polynucleotide
ucauuuuccauacagucagu

SEQ ID NO: 450 - RNA, 20 nt, Artificial Sequence
  Synthetic Polynucleotide
gguccugccgcugcuuguca

SEQ ID NO: 451 - RNA, 20 nt, Artificial Sequence
  Synthetic Polynucleotide
cugguccugccgcugcuugu

SEQ ID NO: 452 - RNA, 20 nt, Artificial Sequence
  Synthetic Polynucleotide
ucccgaguagcagaugacca

SEQ ID NO: 453 - RNA, 20 nt, Artificial Sequence
  Synthetic Polynucleotide
uaggauucccgaguagcaga

SEQ ID NO: 454 - RNA, 20 nt, Artificial Sequence
  Synthetic Polynucleotide
uuuuaggauucccgaguagc

SEQ ID NO: 455 - RNA, 20 nt, Artificial Sequence
  Synthetic Polynucleotide
ucucugucaccugcauagcu

SEQ ID NO: 456 - RNA, 20 nt, Artificial Sequence
  Synthetic Polynucleotide
aagagucucugucaccugca

SEQ ID NO: 457 - RNA, 20 nt, Artificial Sequence
  Synthetic Polynucleotide
agucucugucaccugcauag

SEQ ID NO: 458 - RNA, 22 nt, Artificial Sequence
  Synthetic Polynucleotide
ccaagagucucugucaccugca

SEQ ID NO: 459 - RNA, 20 nt, Artificial Sequence
  Synthetic Polynucleotide
gcagcagugcgucaucccaa

SEQ ID NO: 460 - RNA, 20 nt, Artificial Sequence
  Synthetic Polynucleotide
ugcagcagugcgucauccca

SEQ ID NO: 461 - RNA, 20 nt, Artificial Sequence
  Synthetic Polynucleotide
augcagcagugcgucauccc

SEQ ID NO: 462 - RNA, 20 nt, Artificial Sequence
  Synthetic Polynucleotide
augcagcagugcgucauccc

SEQ ID NO: 463 - RNA, 20 nt, Artificial Sequence
  Synthetic Polynucleotide
gcagcagugcgucaucccaa

SEQ ID NO: 464 - RNA, 20 nt, Artificial Sequence
  Synthetic Polynucleotide
augcagcagugcgucauccc

SEQ ID NO: 465 - RNA, 20 nt, Artificial Sequence
  Synthetic Polynucleotide
augcagcagugcgucauccc

SEQ ID NO: 466 - RNA, 20 nt, Artificial Sequence
  Synthetic Polynucleotide
cccaucaucuaugccuuugu

SEQ ID NO: 467 - RNA, 19 nt, Artificial Sequence
  Synthetic Polynucleotide
ccaucaucuaugccuuugu

SEQ ID NO: 468 - RNA, 20 nt, Artificial Sequence
  Synthetic Polynucleotide
ggcucccgagcgagcaagcu

SEQ ID NO: 469 - RNA, 20 nt, Artificial Sequence
  Synthetic Polynucleotide
caagaggcucccgagcgagc

SEQ ID NO: 470 - RNA, 20 nt, Artificial Sequence
  Synthetic Polynucleotide
gaggcucccgagcgagcaag

SEQ ID NO: 471 - RNA, 20 nt, Artificial Sequence
  Synthetic Polynucleotide
caagugucaaguccaaucua

SEQ ID NO: 472 - RNA, 20 nt, Artificial Sequence
  Synthetic Polynucleotide
aagauggauuaucaaguguc

SEQ ID NO: 473 - RNA, 20 nt, Artificial Sequence
  Synthetic Polynucleotide
ccugccaaaaaaucaaugug

SEQ ID NO: 474 - RNA, 20 nt, Artificial Sequence
  Synthetic Polynucleotide
ugccaaaaaaucaaugugaa

SEQ ID NO: 475 - RNA, 20 nt, Artificial Sequence
  Synthetic Polynucleotide
cccagaaggggacaguaaga

SEQ ID NO: 476 - RNA, 20 nt, Artificial Sequence
  Synthetic Polynucleotide
gcccagaaggggacaguaag

SEQ ID NO: 477 - RNA, 20 nt, Artificial Sequence
  Synthetic Polynucleotide
gagcccagaaggggacagua

SEQ ID NO: 478 - RNA, 20 nt, Artificial Sequence
  Synthetic Polynucleotide
ugagcccagaaggggacagu

SEQ ID NO: 479 - RNA, 21 nt, Artificial Sequence
  Synthetic Polynucleotide
agcauagugagcccagaaggg

SEQ ID NO: 480 - RNA, 20 nt, Artificial Sequence
  Synthetic Polynucleotide
gcugccgcccagugggacuu

SEQ ID NO: 481 - RNA, 20 nt, Artificial Sequence
  Synthetic Polynucleotide
cugccgcccagugggacuuu

SEQ ID NO: 482 - RNA, 20 nt, Artificial Sequence
  Synthetic Polynucleotide
cugccgcccagugggacuuu

SEQ ID NO: 483 - RNA, 20 nt, Artificial Sequence
  Synthetic Polynucleotide
gcccagugggacuuuggaaa

SEQ ID NO: 484 - RNA, 20 nt, Artificial Sequence
  Synthetic Polynucleotide
agucccacugggcggcagca

SEQ ID NO: 485 - RNA, 20 nt, Artificial Sequence
  Synthetic Polynucleotide
uccaaagucccacugggcgg

SEQ ID NO: 486 - RNA, 20 nt, Artificial Sequence
  Synthetic Polynucleotide
cccacugggcggcagcauag

SEQ ID NO: 487 - RNA, 20 nt, Artificial Sequence
  Synthetic Polynucleotide
gucccacugggcggcagcau

SEQ ID NO: 488 - RNA, 21 nt, Artificial Sequence
  Synthetic Polynucleotide
caaagucccacugggcggcag

SEQ ID NO: 489 - RNA, 20 nt, Artificial Sequence
  Synthetic Polynucleotide
caaugugucaacucuugaca

SEQ ID NO: 490 - RNA, 20 nt, Artificial Sequence
  Synthetic Polynucleotide
acaaugugucaacucuugac

SEQ ID NO: 491 - RNA, 20 nt, Artificial Sequence
  Synthetic Polynucleotide
uuuaccagaucucaaaaaga

SEQ ID NO: 492 - RNA, 20 nt, Artificial Sequence
  Synthetic Polynucleotide
acagucaguaucaauucugg

SEQ ID NO: 493 - RNA, 20 nt, Artificial Sequence
  Synthetic Polynucleotide
cauacagucaguaucaauuc

SEQ ID NO: 494 - RNA, 20 nt, Artificial Sequence
  Synthetic Polynucleotide
auacagucaguaucaauucu

SEQ ID NO: 495 - RNA, 20 nt, Artificial Sequence
  Synthetic Polynucleotide
cagucaguaucaauucugga

SEQ ID NO: 496 - RNA, 20 nt, Artificial Sequence
  Synthetic Polynucleotide
acagucaguaucaauucugg

SEQ ID NO: 497 - RNA, 20 nt, Artificial Sequence
  Synthetic Polynucleotide
aucaauucuggaagaauuuc

SEQ ID NO: 498 - RNA, 20 nt, Artificial Sequence
  Synthetic Polynucleotide
acagucaguaucaauucugg

SEQ ID NO: 499 - RNA, 20 nt, Artificial Sequence
  Synthetic Polynucleotide
cagucaguaucaauucugga

SEQ ID NO: 500 - RNA, 20 nt, Artificial Sequence
  Synthetic Polynucleotide
ucaauucuggaagaauuucc

SEQ ID NO: 501 - RNA, 20 nt, Artificial Sequence
  Synthetic Polynucleotide
acagucaguaucaauucugg

SEQ ID NO: 502 - RNA, 20 nt, Artificial Sequence
  Synthetic Polynucleotide
cagaauugauacugacugua

SEQ ID NO: 503 - RNA, 20 nt, Artificial Sequence
  Synthetic Polynucleotide
aauucuuccagaauugauac

SEQ ID NO: 504 - RNA, 20 nt, Artificial Sequence
  Synthetic Polynucleotide
gaauuuccagacauuaaaga

SEQ ID NO: 505 - RNA, 20 nt, Artificial Sequence
  Synthetic Polynucleotide
ggaagaauuuccagacauua

SEQ ID NO: 506 - RNA, 20 nt, Artificial Sequence
  Synthetic Polynucleotide
gaagaauuuccagacauuaa

SEQ ID NO: 507 - RNA, 20 nt, Artificial Sequence
  Synthetic Polynucleotide
uggaagaauuuccagacauu

SEQ ID NO: 508 - RNA, 20 nt, Artificial Sequence
  Synthetic Polynucleotide
aagaauuuccagacauuaaa

SEQ ID NO: 509 - RNA, 21 nt, Artificial Sequence
  Synthetic Polynucleotide
ccagaagagaaaauaaacaau

SEQ ID NO: 510 - RNA, 20 nt, Artificial Sequence
  Synthetic Polynucleotide
ggagcccagaagagaaaaua

SEQ ID NO: 511 - RNA, 20 nt, Artificial Sequence
  Synthetic Polynucleotide
aacaccuuccaggaauucuu

SEQ ID NO: 512 - RNA, 20 nt, Artificial Sequence
  Synthetic Polynucleotide
cuuccaggaauucuuuggcc

SEQ ID NO: 513 - RNA, 20 nt, Artificial Sequence
  Synthetic Polynucleotide
ccuuccaggaauucuuuggc

SEQ ID NO: 514 - RNA, 20 nt, Artificial Sequence
  Synthetic Polynucleotide
uccaggaauucuuuggccug

SEQ ID NO: 515 - RNA, 20 nt, Artificial Sequence
  Synthetic Polynucleotide
ggaccaagcuaugcagguga

SEQ ID NO: 516 - RNA, 20 nt, Artificial Sequence
  Synthetic Polynucleotide
accaagcuaugcaggugaca

SEQ ID NO: 517 - RNA, 20 nt, Artificial Sequence
  Synthetic Polynucleotide
acagguuggaccaagcuaug

SEQ ID NO: 518 - RNA, 20 nt, Artificial Sequence
  Synthetic Polynucleotide
cagguuggaccaagcuaugc

SEQ ID NO: 519 - RNA, 20 nt, Artificial Sequence
  Synthetic Polynucleotide
agguuggaccaagcuaugca

SEQ ID NO: 520 - RNA, 20 nt, Artificial Sequence
  Synthetic Polynucleotide
guuggaccaagcuaugcagg

SEQ ID NO: 521 - RNA, 20 nt, Artificial Sequence
  Synthetic Polynucleotide
gaccaagcuaugcaggugac

SEQ ID NO: 522 - RNA, 20 nt, Artificial Sequence
  Synthetic Polynucleotide
aacagguuggaccaagcuau

SEQ ID NO: 523 - RNA, 20 nt, Artificial Sequence
  Synthetic Polynucleotide
augcaggugacagagacucu

SEQ ID NO: 524 - RNA, 20 nt, Artificial Sequence
  Synthetic Polynucleotide
ugcaggugacagagacucuu

SEQ ID NO: 525 - RNA, 20 nt, Artificial Sequence
  Synthetic Polynucleotide
gaccaagcuaugcaggugac

SEQ ID NO: 526 - RNA, 20 nt, Artificial Sequence
  Synthetic Polynucleotide
accaagcuaugcaggugaca

SEQ ID NO: 527 - RNA, 20 nt, Artificial Sequence
  Synthetic Polynucleotide
ccaagcuaugcaggugacag

SEQ ID NO: 528 - RNA, 20 nt, Artificial Sequence
  Synthetic Polynucleotide
gcaggugacagagacucuug

SEQ ID NO: 529 - RNA, 20 nt, Artificial Sequence
  Synthetic Polynucleotide
augcaggugacagagacucu

SEQ ID NO: 530 - RNA, 20 nt, Artificial Sequence
  Synthetic Polynucleotide
uuuuccagcaagaggcuccc

SEQ ID NO: 531 - RNA, 20 nt, Artificial Sequence
  Synthetic Polynucleotide
auuuuccagcaagaggcucc

SEQ ID NO: 532 - RNA, 20 nt, Artificial Sequence
  Synthetic Polynucleotide
uuuccagcaagaggcucccg

SEQ ID NO: 533 - RNA, 20 nt, Artificial Sequence
  Synthetic Polynucleotide
uccagcaagaggcucccgag

SEQ ID NO: 534 - RNA, 20 nt, Artificial Sequence
  Synthetic Polynucleotide
ccagcaagaggcucccgagc

SEQ ID NO: 535 - RNA, 20 nt, Artificial Sequence
  Synthetic Polynucleotide
ggcucccgagcgagcaagcu

SEQ ID NO: 536 - RNA, 20 nt, Artificial Sequence
  Synthetic Polynucleotide
gaggcucccgagcgagcaag

SEQ ID NO: 537 - RNA, 20 nt, Artificial Sequence
  Synthetic Polynucleotide
gcgagcaagcucaguuuaca

SEQ ID NO: 538 - RNA, 20 nt, Artificial Sequence
  Synthetic Polynucleotide
guuuacacccgauccacugg

SEQ ID NO: 539 - RNA, 20 nt, Artificial Sequence
  Synthetic Polynucleotide
acacccgauccacuggggag

SEQ ID NO: 540 - RNA, 20 nt, Artificial Sequence
  Synthetic Polynucleotide
cacccgauccacuggggagc

SEQ ID NO: 541 - RNA, 20 nt, Artificial Sequence
  Synthetic Polynucleotide
acccgauccacuggggagca

SEQ ID NO: 542 - RNA, 20 nt, Artificial Sequence
  Synthetic Polynucleotide
acccgauccacuggggagca

SEQ ID NO: 543 - RNA, 20 nt, Artificial Sequence
  Synthetic Polynucleotide
ggggagcaggaaauaucugu

SEQ ID NO: 544 - RNA, 20 nt, Artificial Sequence
  Synthetic Polynucleotide
uggggagcaggaaauaucug

SEQ ID NO: 545 - RNA, 20 nt, Artificial Sequence
  Synthetic Polynucleotide
acuggggagcaggaaauauc

SEQ ID NO: 546 - RNA, 20 nt, Artificial Sequence
  Synthetic Polynucleotide
gcaggaaauaucugugggcu

SEQ ID NO: 547 - RNA, 20 nt, Artificial Sequence
  Synthetic Polynucleotide
gaggcucccgagcgagcaag

SEQ ID NO: 548 - RNA, 20 nt, Artificial Sequence
  Synthetic Polynucleotide
gaggcucccgagcgagcaag

SEQ ID NO: 549 - RNA, 20 nt, Artificial Sequence
  Synthetic Polynucleotide
uccaaagucccacugggcgg

SEQ ID NO: 550 - RNA, 20 nt, Artificial Sequence
  Synthetic Polynucleotide
gcagcagugcgucaucccaa

SEQ ID NO: 551 - RNA, 20 nt, Artificial Sequence
  Synthetic Polynucleotide
gagcccugccaaaaaaucaa

SEQ ID NO: 552 - RNA, 21 nt, Artificial Sequence
  Synthetic Polynucleotide
caaagucccacugggcggcag

SEQ ID NO: 553 - RNA, 20 nt, Artificial Sequence
  Synthetic Polynucleotide
uuuccagcaagaggcucccg

SEQ ID NO: 554 - RNA, 20 nt, Artificial Sequence
  Synthetic Polynucleotide
acagucaguaucaauucugg

SEQ ID NO: 555 - RNA, 20 nt, Artificial Sequence
  Synthetic Polynucleotide
gauuccagagaagaagccua

SEQ ID NO: 556 - RNA, 20 nt, Artificial Sequence
  Synthetic Polynucleotide
uauacaucggagcccugcca

SEQ ID NO: 557 - RNA, 20 nt, Artificial Sequence
  Synthetic Polynucleotide
gagcaagcucaguuuacacc

SEQ ID NO: 558 - RNA, 20 nt, Artificial Sequence
  Synthetic Polynucleotide
guuuacacccgauccacugg

SEQ ID NO: 559 - RNA, 20 nt, Artificial Sequence
  Synthetic Polynucleotide
agguuggaccaagcuaugca

SEQ ID NO: 560 - RNA, 20 nt, Artificial Sequence
  Synthetic Polynucleotide
agucucugucaccugcauag

SEQ ID NO: 561 - RNA, 20 nt, Artificial Sequence
  Synthetic Polynucleotide
aaaaccaaagaugaacacca

SEQ ID NO: 562 - RNA, 20 nt, Artificial Sequence
  Synthetic Polynucleotide
guaaagaugauuccugggag

SEQ ID NO: 563 - RNA, 20 nt, Artificial Sequence
  Synthetic Polynucleotide
acagucaguaucaauucugg

SEQ ID NO: 564 - RNA, 20 nt, Artificial Sequence
  Synthetic Polynucleotide
ggagcccagaagagaaaaua

SEQ ID NO: 565 - RNA, 20 nt, Artificial Sequence
  Synthetic Polynucleotide
cauguugcccacaaaaccaa

SEQ ID NO: 566 - RNA, 20 nt, Artificial Sequence
  Synthetic Polynucleotide
acagguuggaccaagcuaug

SEQ ID NO: 567 - RNA, 20 nt, Artificial Sequence
  Synthetic Polynucleotide
aacagguuggaccaagcuau

SEQ ID NO: 568 - RNA, 20 nt, Artificial Sequence
  Synthetic Polynucleotide
ucauuuuccauacagucagu

SEQ ID NO: 569 - RNA, 20 nt, Artificial Sequence
  Synthetic Polynucleotide
ucauuuuccauacagucagu

SEQ ID NO: 570 - RNA, 20 nt, Artificial Sequence
  Synthetic Polynucleotide
gcgagcaagcucaguuuaca

SEQ ID NO: 571 - RNA, 20 nt, Artificial Sequence
  Synthetic Polynucleotide
aucacacuugucaccacccc

SEQ ID NO: 572 - RNA, 20 nt, Artificial Sequence
  Synthetic Polynucleotide
uuggcagggcuccgauguau

SEQ ID NO: 573 - RNA, 20 nt, Artificial Sequence
  Synthetic Polynucleotide
caagugucaaguccaaucua

SEQ ID NO: 574 - RNA, 20 nt, Artificial Sequence
  Synthetic Polynucleotide
ugagagcugcagguguaaug

SEQ ID NO: 575 - RNA, 20 nt, Artificial Sequence
  Synthetic Polynucleotide
caagaggcucccgagcgagc

SEQ ID NO: 576 - RNA, 20 nt, Artificial Sequence
  Synthetic Polynucleotide
gcccagugggacuuuggaaa

SEQ ID NO: 577 - RNA, 20 nt, Artificial Sequence
  Synthetic Polynucleotide
cagggcuccgauguauaaua

SEQ ID NO: 578 - RNA, 20 nt, Artificial Sequence
  Synthetic Polynucleotide
uaauccaucuuguuccaccc

SEQ ID NO: 579 - RNA, 20 nt, Artificial Sequence
  Synthetic Polynucleotide
ggcucccgagcgagcaagcu

SEQ ID NO: 580 - RNA, 20 nt, Artificial Sequence
  Synthetic Polynucleotide
ggcucccgagcgagcaagcu

SEQ ID NO: 581 - RNA, 20 nt, Artificial Sequence
  Synthetic Polynucleotide
uaggauucccgaguagcaga

SEQ ID NO: 582 - RNA, 20 nt, Artificial Sequence
  Synthetic Polynucleotide
gagcccagaaggggacagua

SEQ ID NO: 583 - RNA, 20 nt, Artificial Sequence
  Synthetic Polynucleotide
augcagcagugcgucauccc

SEQ ID NO: 584 - RNA, 20 nt, Artificial Sequence
  Synthetic Polynucleotide
acuugucaccaccccaaagg

SEQ ID NO: 585 - RNA, 20 nt, Artificial Sequence
  Synthetic Polynucleotide
acugcaauuauucaggccaa

SEQ ID NO: 586 - RNA, 21 nt, Artificial Sequence
  Synthetic Polynucleotide
ccaucuuguuccacccugugc

SEQ ID NO: 587 - RNA, 20 nt, Artificial Sequence
  Synthetic Polynucleotide
gagagcugcagguguaauga

SEQ ID NO: 588 - RNA, 20 nt, Artificial Sequence
  Synthetic Polynucleotide
cacacuugucaccaccccaa

SEQ ID NO: 589 - RNA, 20 nt, Artificial Sequence
  Synthetic Polynucleotide
caucggagcccugccaaaaa

SEQ ID NO: 590 - RNA, 20 nt, Artificial Sequence
  Synthetic Polynucleotide
uccaggaauucuuuggccug

SEQ ID NO: 591 - RNA, 20 nt, Artificial Sequence
  Synthetic Polynucleotide
augcagcagugcgucauccc

SEQ ID NO: 592 - RNA, 20 nt, Artificial Sequence
  Synthetic Polynucleotide
cugccgcccagugggacuuu

SEQ ID NO: 593 - RNA, 20 nt, Artificial Sequence
  Synthetic Polynucleotide
uacugcaauuauucaggcca

SEQ ID NO: 594 - RNA, 20 nt, Artificial Sequence
  Synthetic Polynucleotide
cugguccugccgcugcuugu

SEQ ID NO: 595 - RNA, 20 nt, Artificial Sequence
  Synthetic Polynucleotide
guugcccacaaaaccaaaga

SEQ ID NO: 596 - RNA, 20 nt, Artificial Sequence
  Synthetic Polynucleotide
agcauguugcccacaaaacc

SEQ ID NO: 597 - RNA, 20 nt, Artificial Sequence
  Synthetic Polynucleotide
gcugccgcccagugggacuu

SEQ ID NO: 598 - RNA, 20 nt, Artificial Sequence
  Synthetic Polynucleotide
acccgauccacuggggagca

SEQ ID NO: 599 - RNA, 20 nt, Artificial Sequence
  Synthetic Polynucleotide
ccugccuccgcucuacucac

SEQ ID NO: 600 - RNA, 20 nt, Artificial Sequence
  Synthetic Polynucleotide
ucccgaguagcagaugacca

SEQ ID NO: 601 - RNA, 20 nt, Artificial Sequence
  Synthetic Polynucleotide
ugcacaggguggaacaagau

SEQ ID NO: 602 - RNA, 20 nt, Artificial Sequence
  Synthetic Polynucleotide
augcacaggguggaacaaga

SEQ ID NO: 603 - RNA, 20 nt, Artificial Sequence
  Synthetic Polynucleotide
uuccacccugugcauaaaua

SEQ ID NO: 604 - RNA, 20 nt, Artificial Sequence
  Synthetic Polynucleotide
cccugugcauaaauaaaaag

SEQ ID NO: 605 - RNA, 20 nt, Artificial Sequence
  Synthetic Polynucleotide
cagguuggaccaagcuaugc

SEQ ID NO: 606 - RNA, 20 nt, Artificial Sequence
  Synthetic Polynucleotide
cugccgcccagugggacuuu

SEQ ID NO: 607 - RNA, 22 nt, Artificial Sequence
  Synthetic Polynucleotide
cgaagcagaguuuuuaggauuc

SEQ ID NO: 608 - RNA, 20 nt, Artificial Sequence
  Synthetic Polynucleotide
ccacaaaaccaaagaugaac

SEQ ID NO: 609 - RNA, 20 nt, Artificial Sequence
  Synthetic Polynucleotide
gguccugccgcugcuuguca

SEQ ID NO: 610 - RNA, 20 nt, Artificial Sequence
  Synthetic Polynucleotide
cuccugccuccgcucuacuc

SEQ ID NO: 611 - RNA, 20 nt, Artificial Sequence
  Synthetic Polynucleotide
cccacugggcggcagcauag

SEQ ID NO: 612 - RNA, 20 nt, Artificial Sequence
  Synthetic Polynucleotide
auuuaugcacaggguggaac

SEQ ID NO: 613 - RNA, 20 nt, Artificial Sequence
  Synthetic Polynucleotide
uuuaugcacaggguggaaca

SEQ ID NO: 614 - RNA, 20 nt, Artificial Sequence
  Synthetic Polynucleotide
ugcagcagugcgucauccca

SEQ ID NO: 615 - RNA, 20 nt, Artificial Sequence
  Synthetic Polynucleotide
cagaauugauacugacugua

SEQ ID NO: 616 - RNA, 20 nt, Artificial Sequence
  Synthetic Polynucleotide
acaaugugucaacucuugac

SEQ ID NO: 617 - RNA, 20 nt, Artificial Sequence
  Synthetic Polynucleotide
ugccaaaaaaucaaugugaa

SEQ ID NO: 618 - RNA, 20 nt, Artificial Sequence
  Synthetic Polynucleotide
gagggcaacuaaauacauuc

SEQ ID NO: 619 - RNA, 20 nt, Artificial Sequence
  Synthetic Polynucleotide
augcaggugacagagacucu

SEQ ID NO: 620 - RNA, 20 nt, Artificial Sequence
  Synthetic Polynucleotide
cacccgauccacuggggagc

SEQ ID NO: 621 - RNA, 20 nt, Artificial Sequence
  Synthetic Polynucleotide
acaccgaagcagaguuuuua

SEQ ID NO: 622 - RNA, 20 nt, Artificial Sequence
  Synthetic Polynucleotide
ucucccaggaaucaucuuua

SEQ ID NO: 623 - RNA, 20 nt, Artificial Sequence
  Synthetic Polynucleotide
cuuccaggaauucuuuggcc

SEQ ID NO: 624 - RNA, 20 nt, Artificial Sequence
  Synthetic Polynucleotide
agggcaacuaaauacauucu

SEQ ID NO: 625 - RNA, 20 nt, Artificial Sequence
  Synthetic Polynucleotide
aauucuuccagaauugauac

SEQ ID NO: 626 - RNA, 20 nt, Artificial Sequence
  Synthetic Polynucleotide
ucccaggaaucaucuuuacc

SEQ ID NO: 627 - RNA, 20 nt, Artificial Sequence
  Synthetic Polynucleotide
auuuuccagcaagaggcucc

SEQ ID NO: 628 - RNA, 20 nt, Artificial Sequence
  Synthetic Polynucleotide
aaacuguuuuauacaucaau

SEQ ID NO: 629 - RNA, 20 nt, Artificial Sequence
  Synthetic Polynucleotide
cgacaccgaagcagaguuuu

SEQ ID NO: 630 - RNA, 20 nt, Artificial Sequence
  Synthetic Polynucleotide
ccuuccaggaauucuuuggc

SEQ ID NO: 631 - RNA, 20 nt, Artificial Sequence
  Synthetic Polynucleotide
caccccaaaggugaccgucc

SEQ ID NO: 632 - RNA, 20 nt, Artificial Sequence
  Synthetic Polynucleotide
cgacaccgaagcagaguuuu

SEQ ID NO: 633 - RNA, 20 nt, Artificial Sequence
  Synthetic Polynucleotide
cccaucaucuaugccuuugu

SEQ ID NO: 634 - RNA, 20 nt, Artificial Sequence
  Synthetic Polynucleotide
gacaccgaagcagaguuuuu

SEQ ID NO: 635 - RNA, 20 nt, Artificial Sequence
  Synthetic Polynucleotide
aacaccuuccaggaauucuu

SEQ ID NO: 636 - RNA, 20 nt, Artificial Sequence
  Synthetic Polynucleotide
cauacagucaguaucaauuc

SEQ ID NO: 637 - RNA, 20 nt, Artificial Sequence
  Synthetic Polynucleotide
gcagcagugcgucaucccaa

SEQ ID NO: 638 - RNA, 20 nt, Artificial Sequence
  Synthetic Polynucleotide
aaaaccaaagaugaacacca

SEQ ID NO: 639 - RNA, 20 nt, Artificial Sequence
  Synthetic Polynucleotide
guaaagaugauuccugggag

SEQ ID NO: 640 - RNA, 20 nt, Artificial Sequence
  Synthetic Polynucleotide
cauguugcccacaaaaccaa

SEQ ID NO: 641 - RNA, 20 nt, Artificial Sequence
  Synthetic Polynucleotide
uaggauucccgaguagcaga

SEQ ID NO: 642 - RNA, 20 nt, Artificial Sequence
  Synthetic Polynucleotide
augcagcagugcgucauccc

SEQ ID NO: 643 - RNA, 20 nt, Artificial Sequence
  Synthetic Polynucleotide
acuugucaccaccccaaagg

SEQ ID NO: 644 - RNA, 20 nt, Artificial Sequence
  Synthetic Polynucleotide
cacacuugucaccaccccaa

SEQ ID NO: 645 - RNA, 20 nt, Artificial Sequence
  Synthetic Polynucleotide
augcagcagugcgucauccc

SEQ ID NO: 646 - RNA, 20 nt, Artificial Sequence
  Synthetic Polynucleotide
guugcccacaaaaccaaaga

SEQ ID NO: 647 - RNA, 20 nt, Artificial Sequence
  Synthetic Polynucleotide
ccugccuccgcucuacucac

SEQ ID NO: 648 - RNA, 20 nt, Artificial Sequence
  Synthetic Polynucleotide
ucccgaguagcagaugacca

SEQ ID NO: 649 - RNA, 20 nt, Artificial Sequence
  Synthetic Polynucleotide
ugcagcagugcgucauccca

SEQ ID NO: 650 - RNA, 20 nt, Artificial Sequence
  Synthetic Polynucleotide
augcaggugacagagacucu

SEQ ID NO: 651 - RNA, 20 nt, Artificial Sequence
  Synthetic Polynucleotide
cuuccaggaauucuuuggcc

SEQ ID NO: 652 - RNA, 20 nt, Artificial Sequence
  Synthetic Polynucleotide
cgacaccgaagcagaguuuu

SEQ ID NO: 653 - RNA, 20 nt, Artificial Sequence
  Synthetic Polynucleotide
ccuuccaggaauucuuuggc

SEQ ID NO: 654 - RNA, 20 nt, Artificial Sequence
  Synthetic Polynucleotide
caccccaaaggugaccgucc

SEQ ID NO: 655 - RNA, 20 nt, Artificial Sequence
  Synthetic Polynucleotide
cgacaccgaagcagaguuuu

SEQ ID NO: 656 - RNA, 20 nt, Artificial Sequence
  Synthetic Polynucleotide
cccaucaucuaugccuuugu

SEQ ID NO: 657 - RNA, 20 nt, Artificial Sequence
  Synthetic Polynucleotide
aacaccuuccaggaauucuu

SEQ ID NO: 658 - RNA, 20 nt, Artificial Sequence
  Synthetic Polynucleotide
gcagcaggagcacccaagag

SEQ ID NO: 659 - RNA, 24 nt, Artificial Sequence
  Synthetic Polynucleotide
aaaaccaaagagaacaccagcgag

SEQ ID NO: 660 - RNA, 19 nt, Artificial Sequence
  Synthetic Polynucleotide
gaaagagaccgggacagac

SEQ ID NO: 661 - RNA, 20 nt, Artificial Sequence
  Synthetic Polynucleotide
caggcccacaaaaccaaaga

SEQ ID NO: 662 - RNA, 20 nt, Artificial Sequence
  Synthetic Polynucleotide
caggacccgagagcagagac

SEQ ID NO: 663 - RNA, 21 nt, Artificial Sequence
  Synthetic Polynucleotide
agcagcaggagcacccaagag

SEQ ID NO: 664 - RNA, 20 nt, Artificial Sequence
  Synthetic Polynucleotide
acgcaccaccccaaagggac

SEQ ID NO: 665 - RNA, 20 nt, Artificial Sequence
  Synthetic Polynucleotide
cacacgcaccaccccaaagg

SEQ ID NO: 666 - RNA, 19 nt, Artificial Sequence
  Synthetic Polynucleotide
agcagcaggagcacccaag

SEQ ID NO: 667 - RNA, 21 nt, Artificial Sequence
  Synthetic Polynucleotide
ggcccacaaaaccaaagagaa

SEQ ID NO: 668 - RNA, 17 nt, Artificial Sequence
  Synthetic Polynucleotide
ccgccccgccaccgcgg

SEQ ID NO: 669 - RNA, 20 nt, Artificial Sequence
  Synthetic Polynucleotide
cccgagagcagagaccagac

SEQ ID NO: 670 - RNA, 20 nt, Artificial Sequence
  Synthetic Polynucleotide
gcagcaggagcacccaagag

SEQ ID NO: 671 - RNA, 21 nt, Artificial Sequence
  Synthetic Polynucleotide
acgcagggacagagaccggga

SEQ ID NO: 672 - RNA, 17 nt, Artificial Sequence
  Synthetic Polynucleotide
cccaggaaccggccgaa

SEQ ID NO: 673 - RNA, 21 nt, Artificial Sequence
  Synthetic Polynucleotide
cgacaccgaagcagggcagga

SEQ ID NO: 674 - RNA, 18 nt, Artificial Sequence
  Synthetic Polynucleotide
ccccaggaaccggccgag

SEQ ID NO: 675 - RNA, 20 nt, Artificial Sequence
  Synthetic Polynucleotide
caccccaaagggaccgccgg

SEQ ID NO: 676 - RNA, 19 nt, Artificial Sequence
  Synthetic Polynucleotide
cgacaccgaagcagggcag

SEQ ID NO: 677 - RNA, 15 nt, Artificial Sequence
  Synthetic Polynucleotide
cccacacagcccggg

SEQ ID NO: 678 - RNA, 17 nt, Artificial Sequence
  Synthetic Polynucleotide
aacaccccaggaaccgg

SEQ ID NO: 679 - DNA, 4104 bp, Streptococcus pyogenes
atggataagaaatactcaataggcttagatatcggcacaaatagcgtcggatgggcggtgatcactgatgattataaggttccgtctaaaaagttcaaggttctgggaaatacagaccgccacagtatcaaaaaaaatcttataggggctcttttatttggcagtggagagacagcggaagcgactcgtctcaaacggacagctcgtagaaggtatacacgtcggaagaatcgtatttgttatctacaggagattttttcaaatgagatggcgaaagtagatgatagtttctttcatcgacttgaagagtcttttttggtggaagaagacaagaagcatgaacgtcatcctatttttggaaatatagtagatgaagttgcttatcatgagaaatatccaactatctatcatctgcgaaaaaaattggcagattctactgataaagcggatttgcgcttaatctatttggccttagcgcatatgattaagtttcgtggtcattttttgattgagggagatttaaatcctgataatagtgatgtggacaaactatttatccagttggtacaaatctacaatcaattatttgaagaaaaccctattaacgcaagtagagtagatgctaaagcgattctttctgcacgattgagtaaatcaagacgattagaaaatctcattgctcagctccccggtgagaagagaaatggcttgtttgggaatctcattgctttgtcattgggattgacccctaattttaaatcaaattttgatttggcagaagatgctaaattacagctttcaaaagatacttacgatgatgatttagataatttattggcgcaaattggagatcaatatgctgatttgtttttggcagctaagaatttatcagatgctattttactttcagatatcctaagagtaaatagtgaaataactaaggctcccctatcagcttcaatgattaagcgctacgatgaacatcatcaagacttgactcttttaaaagctttagttcgacaacaacttccagaaaagtataaagaaatcttttttgatcaatcaaaaaacggatatgcaggttatattgatgggggagctagccaagaagaattttataaatttatcaaaccaattttagaaaaaatggatggtactgaggaattattggtgaaactaaatcgtgaagatttgctgcgcaagcaacggacctttgacaacggctctattccccatcaaattcacttgggtgagctgcatgctattttgagaagacaagaagacttttatccatttttaaaagacaatcgtgagaagattgaaaaaatcttgacttttcgaattccttattatgttggtccattggcgcgtggcaatagtcgttttgcatggatgactcggaagtctgaagaaacaattaccccatggaattttgaagaagttgtcgataaaggtgcttcagctcaatcatttattgaacgcatgacaaactttgataaaaatcttccaaatgaaaaagtactaccaaaacatagtttgctttatgagtattttacggtttataacgaattgacaaaggtcaaatatgttactgagggaatgcgaaaaccagcatttctttcaggtgaacagaagaaagccattgttgatttactcttcaaaacaaatcgaaaagtaaccgttaagcaattaaaagaagattatttcaaaaaaatagaatgttttgatagtgttgaaatttcaggagttgaagatagatttaatgcttcattaggcgcctaccatgatttgctaaaaattattaaagataaagattttttggataatgaagaaaatgaagatatcttagaggatattgttttaacattgaccttatttgaagatagggggatgattgaggaaagacttaaaacatatgctcacctctttgatgataaggtgatgaaacagcttaaacgtcgccgttatactggttggggacgtttgtctcgaaaattgattaatggtattagggataagcaatctggcaaaacaatattagattttttgaaatcagatggttttgccaatcgcaattttatgcagctgatccatgatgatagtttgacatttaaagaagatattcaaaaagcacaggtgtctggacaaggccatagtttacatgaacagattgctaacttagctggcagtcctgctattaaaaaaggtattttacagactgtaaaaattgttgatgaactggtcaaagtaatggggcataagccagaaaatatcgttattgaaatggcacgtgaaaatcagacaactcaaaagggccagaaaaattcgcgagagcgtatgaaacgaatcgaagaaggtatcaaagaattaggaagtcagattcttaaagagcatcctgttgaaaatactcaattgcaaaatgaaaagctctatctctattatctacaaaatggaagagacatgtatgtggaccaagaattagatattaatcgtttaagtgattatgatgtcgatcacattgttccacaaagtttcattaaagacgattcaatagacaataaggtactaacgcgttctgataaaaatcgtggtaaatcggataacgttccaagtgaagaagtagtcaaaaagatgaaaaactattggagacaacttctaaacgccaagttaatcactcaacgtaagtttgataatttaacgaaagctgaacgtggaggtttgagtgaacttgataaagctggttttatcaaacgccaattggttgaaactcgccaaatcactaagcatgtggcacaaattttggatagtcgcatgaatactaaatacgatgaaaatgataaacttattcgagaggttaaagtgattaccttaaaatctaaattagtttctgacttccgaaaagatttccaattctataaagtacgtgagattaacaattaccatcatgcccatgatgcgtatctaaatgccgtcgttggaactgctttgattaagaaatatccaaaacttgaatcggagtttgtctatggtgattataaagtttatgatgttcgtaaaatgattgctaagtctgagcaagaaataggcaaagcaaccgcaaaatatttcttttactctaatatcatgaacttcttcaaaacagaaattacacttgcaaatggagagattcgcaaacgccctctaatcgaaactaatggggaaactggagaaattgtctgggataaagggcgagattttgccacagtgcgcaaagtattgtccatgccccaagtcaatattgtcaagaaaacagaagtacagacaggcggattctccaaggagtcaattttaccaaaaagaaattcggacaagcttattgctcgtaaaaaagactgggatccaaaaaaatatggtggttttgatagtccaacggtagcttattcagtcctagtggttgctaaggtggaaaaagggaaatcgaagaagttaaaatccgttaaagagttactagggatcacaattatggaaagaagttcctttgaaaaaaatccgattgactttttagaagctaaaggatataaggaagttaaaaaagacttaatcattaaactacctaaatatagtctttttgagttagaaaacggtcgtaaacggatgctggctagtgccggagaattacaaaaaggaaatgagctggctctgccaagcaaatatgtgaattttttatatttagctagtcattatgaaaagttgaagggtagtccagaagataacgaacaaaaacaattgtttgtggagcagcataagcattatttagatgagattattgagcaaatcagtgaattttctaagcgtgttattttagcagatgccaatttagataaagttcttagtgcatataacaaacatagagacaaaccaatacgtgaacaagcagaaaatattattcatttatttacgttgacgaatcttggagctcccgctgcttttaaatattttgatacaacaattgatcgtaaacgatatacgtctacaaaagaagttttagatgccactcttatccatcaatccatcactggtctttatgaaacacgcattgatttgagtcagctaggaggtgactga

SEQ ID NO: 680 - protein, 1367 aa, Streptococcus pyogenes
MDKKYSIGLDIGTNSVGWAVITDDYKVPSKKFKVLGNTDRHSIKKNLIGALLFGSGETAEATRLKRTARRRYTRRKNRICYLQEIFSNEMAKVDDSFFHRLEESFLVEEDKKHERHPIFGNIVDEVAYHEKYPTIYHLRKKLADSTDKADLRLIYLALAHMIKFRGHFLIEGDLNPDNSDVDKLFIQLVQIYNQLFEENPINASRVDAKAILSARLSKSRRLENLIAQLPGEKRNGLFGNLIALSLGLTPNFKSNFDLAEDAKLQLSKDTYDDDLDNLLAQIGDQYADLFLAAKNLSDAILLSDILRVNSEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGAYHDLLKIIKDKDFLDNEENEDILEDIVLTLTLFEDRGMIEERLKTYAHLFDDKVMKQLKRRRYTGWGRLSRKLINGIRDKQSGKTILDFLKSDGFANRNFMQLIHDDSLTFKEDIQKAQVSGQGHSLHEQIANLAGSPAIKKGILQTVKIVDELVKVMGHKPENIVIEMARENQTTQKGQKNSRERMKRIEEGIKELGSQILKEHPVENTQLQNEKLYLYYLQNGRDMYVDQELDINRLSDYDVDHIVPQSFIKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 681 - DNA, 4212 bp, Streptococcus pyogenes
atggataaaaagtattctattggtttagacatcggcactaattccgttggatgggctgtcataaccgatgaatacaaagtaccttcaaagaaatttaaggtgttggggaacacagaccgtcattcgattaaaaagaatcttatcggtgccctcctattcgatagtggcgaaacggcagaggcgactcgcctgaaacgaaccgctcggagaaggtatacacgtcgcaagaaccgaatatgttacttacaagaaatttttagcaatgagatggccaaagttgacgattctttctttcaccgtttggaagagtccttccttgtcgaagaggacaagaaacatgaacggcaccccatctttggaaacatagtagatgaggtggcatatcatgaaaagtacccaacgatttatcacctcagaaaaaagctagttgactcaactgataaagcggacctgaggttaatctacttggctcttgcccatatgataaagttccgtgggcactttctcattgagggtgatctaaatccggacaactcggatgtcgacaaactgttcatccagttagtacaaacctataatcagttgtttgaagagaaccctataaatgcaagtggcgtggatgcgaaggctattcttagcgcccgcctctctaaatcccgacggctagaaaacctgatcgcacaattacccggagagaagaaaaatgggttgttcggtaaccttatagcgctctcactaggcctgacaccaaattttaagtcgaacttcgacttagctgaagatgccaaattgcagcttagtaaggacacgtacgatgacgatctcgacaatctactggcacaaattggagatcagtatgcggacttatttttggctgccaaaaaccttagcgatgcaatcctcctatctgacatactgagagttaatactgagattaccaaggcgccgttatccgcttcaatgatcaaaaggtacgatgaacatcaccaagacttgacacttctcaaggccctagtccgtcagcaactgcctgagaaatataaggaaatattctttgatcagtcgaaaaacgggtacgcaggttatattgacggcggagcgagtcaagaggaattctacaagtttatcaaacccatattagagaagatggatgggacggaagagttgcttgtaaaactcaatcgcgaagatctactgcgaaagcagcggactttcgacaacggtagcattccacatcaaatccacttaggcgaattgcatgctatacttagaaggcaggaggatttttatccgttcctcaaagacaatcgtgaaaagattgagaaaatcctaacctttcgcataccttactatgtgggacccctggcccgagggaactctcggttcgcatggatgacaagaaagtccgaagaaacgattactccatggaattttgaggaagttgtcgataaaggtgcgtcagctcaatcgttcatcgagaggatgaccaactttgacaagaatttaccgaacgaaaaagtattgcctaagcacagtttactttacgagtatttcacagtgtacaatgaactcacgaaagttaagtatgtcactgagggcatgcgtaaacccgcctttctaagcggagaacagaagaaagcaatagtagatctgttattcaagaccaaccgcaaagtgacagttaagcaattgaaagaggactactttaagaaaattgaatgcttcgattctgtcgagatctccggggtagaagatcgatttaatgcgtcacttggtacgtatcatgacctcctaaagataattaaagataaggacttcctggataacgaagagaatgaagatatcttagaagatatagtgttgactcttaccctctttgaagatcgggaaatgattgaggaaagactaaaaacatacgctcacctgttcgacgataaggttatgaaacagttaaagaggcgtcgctatacgggctggggacgattgtcgcggaaacttatcaacgggataagagacaagcaaagtggtaaaactattctcgattttctaaagagcgacggcttcgccaataggaactttatgcagctgatccatgatgactctttaaccttcaaagaggatatacaaaaggcacaggtttccggacaaggggactcattgcacgaacatattgcgaatcttgctggttcgccagccatcaaaaagggcatactccagacagtcaaagtagtggatgagctagttaaggtcatgggacgtcacaaaccggaaaacattgtaatcgagatggcacgcgaaaatcaaacgactcagaaggggcaaaaaaacagtcgagagcggatgaagagaatagaagagggtattaaagaactgggcagccagatcttaaaggagcatcctgtggaaaatacccaattgcagaacgagaaactttacctctattacctacaaaatggaagggacatgtatgttgatcaggaactggacataaaccgtttatctgattacgacgtcgatcacattgtaccccaatcctttttgaaggacgattcaatcgacaataaagtgcttacacgctcggataagaaccgagggaaaagtgacaatgttccaagcgaggaagtcgtaaagaaaatgaagaactattggcggcagctcctaaatgcgaaactgataacgcaaagaaagttcgataacttaactaaagctgagaggggtggcttgtctgaacttgacaaggccggatttattaaacgtcagctcgtggaaacccgccaaatcacaaagcatgttgcacagatactagattcccgaatgaatacgaaatacgacgagaacgataagctgattcgggaagtcaaagtaatcactttaaagtcaaaattggtgtcggacttcagaaaggattttcaattctataaagttagggagataaataactaccaccatgcgcacgacgcttatcttaatgccgtcgtagggaccgcactcattaagaaatacccgaagctagaaagtgagtttgtgtatggtgattacaaagtttatgacgtccgtaagatgatcgcgaaaagcgaacaggagataggcaaggctacagccaaatacttcttttattctaacattatgaatttctttaagacggaaatcactctggcaaacggagagatacgcaaacgacctttaattgaaaccaatggggagacaggtgaaatcgtatgggataagggccgggacttcgcgacggtgagaaaagttttgtccatgccccaagtcaacatagtaaagaaaactgaggtgcagaccggagggttttcaaaggaatcgattcttccaaaaaggaatagtgataagctcatcgctcgtaaaaaggactgggacccgaaaaagtacggtggcttcgatagccctacagttgcctattctgtcctagtagtggcaaaagttgagaagggaaaatccaagaaactgaagtcagtcaaagaattattggggataacgattatggagcgctcgtcttttgaaaagaaccccatcgacttccttgaggcgaaaggttacaaggaagtaaaaaaggatctcataattaaactaccaaagtatagtctgtttgagttagaaaatggccgaaaacggatgttggctagcgccggagagcttcaaaaggggaacgaactcgcactaccgtctaaatacgtgaatttcctgtatttagcgtcccattacgagaagttgaaaggttcacctgaagataacgaacagaagcaactttttgttgagcagcacaaacattatctcgacgaaatcatagagcaaatttcggaattcagtaagagagtcatcctagctgatgccaatctggacaaagtattaagcgcatacaacaagcacagggataaacccatacgtgagcaggcggaaaatattatccatttgtttactcttaccaacctcggcgctccagccgcattcaagtattttgacacaacgatagatcgcaaacgatacacttctaccaaggaggtgctagacgcgacactgattcaccaatccatcacgggattatatgaaactcggatagatttgtcacagcttgggggtgacggatcccccaagaagaagaggaaagtctcgagcgactacaaagaccatgacggtgattataaagatcatgacatcgattacaaggatgacgatgacaaggctgcagga

SEQ ID NO: 682 - protein, 1368 aa, Streptococcus pyogenes; identical to SEQ ID NO: 3

SEQ ID NO: 683 - protein, 1368 aa, Artificial Sequence; identical to SEQ ID NO: 3
  Synthetic Polypeptide

SEQ ID NO: 684 - protein, 1307 aa, Acidaminococcus
TQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTMLKKQEEKEILKSQLDSLLGLYHLLDWFAVDESNEVDPEFSARLTGIKLEMEPSLSFYNKARNYATKKPYSVEKFKLNFQMPTLASGWDVNKEKNNGAILFVKNGLYYLGIMPKQKGRYKALSFEPTEKTSEGFDKMYYDYFPDAAKMIPKCSTQLKAVTAHFQTHTTPILLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLNYQAANSPSKFNQRVNAYLKEHPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRN

SEQ ID NO: 685 - protein, 1228 aa, Lachnospiraceae
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 686 - protein, 1307 aa, Artificial Sequence
  Synthetic Polypeptide
TQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTMLKKQEEKEILKSQLDSLLGLYHLLDWFAVDESNEVDPEFSARLTGIKLEMEPSLSFYNKARNYATKKPYSVEKFKLNFQMPTLASGWDVNKEKNNGAILFVKNGLYYLGIMPKQKGRYKALSFEPTEKTSEGFDKMYYDYFPDAAKMIPKCSTQLKAVTAHFQTHTTPILLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLNYQAANSPSKFNQRVNAYLKEHPETPIIGIDRGEANLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRN

SEQ ID NO: 687 - protein, 1228 aa, Artificial Sequence
  Synthetic Polypeptide
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGEANLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 688 - protein, 1228 aa, Artificial Sequence
  Synthetic Polypeptide
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMANSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 689 - protein, 1305 aa, Artificial Sequence
  Synthetic Polypeptide
TQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTMLKKQEEKEILKSQLDSLLGLYHLLDWFAVDESNEVDPEFSARLTGIKLEMEPSLSFYNKARNYATKKPYSVEKFKLNFQMPTLASGWDVNKEKNNGAILFVKNGLYYLGIMPKQKGRYKALSFEPTEKTSEGFDKMYYDYFPDAAKMIPKCSTQLKAVTAHFQTHTTPILLSNNFIEPLEITKEIYDLNNPEKEPKKFQTAYAKKGQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLNYQAANSPSKFNQRVNAYLKEHPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRN

SEQ ID NO: 690 - protein, 1303 aa, Artificial Sequence
  Synthetic Polypeptide
TQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTMLKKQEEKEILKSQLDSLLGLYHLLDWFAVDESNEVDPEFSARLTGIKLEMEPSLSFYNKARNYATKKPYSVEKFKLNFQMPTLASGWDVNKEKNNGAILFVKNGLYYLGIMPKQKGRYKALSFEPTEKTSEGFDKMYYDYFPDAAKMIPKCSTQLKAVTAHFQTHTTPILLSNNFIEPLEITKEIYDLNNPEKEPKKFQTAYAKGKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLNYQAANSPSKFNQRVNAYLKEHPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRN

SEQ ID NO: 691 - protein, 1301 aa, Artificial Sequence
  Synthetic Polypeptide
TQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTMLKKQEEKEILKSQLDSLLGLYHLLDWFAVDESNEVDPEFSARLTGIKLEMEPSLSFYNKARNYATKKPYSVEKFKLNFQMPTLASGWDVNKEKNNGAILFVKNGLYYLGIMPKQKGRYKALSFEPTEKTSEGFDKMYYDYFPDAAKMIPKCSTQLKAVTAHFQTHTTPILLSNNFIEPLEITKEIYDLNNPEKEPKKFQTAYAGGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLNYQAANSPSKFNQRVNAYLKEHPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRN

SEQ ID NO: 692 - protein, 1129 aa, Alicyclobacillus acidoterrestris
MAVKSIKVKLRLDDMPEIRAGLWKLHKEVNAGVRYYTEWLSLLRQENLYRRSPNGDGEQECDKTAEECKAELLERLRARQVENGHRGPAGSDDELLQLARQLYELLVPQAIGAKGDAQQIARKFLSPLADKDAVGGLGIAKAGNKPRWVRMREAGEPGWEEEKEKAETRKSADRTADVLRALADFGLKPLMRVYTDSEMSSVEWKPLRKGQAVRTWDRDMFQQAIERMMSWESWNQRVGQEYAKLVEQKNRFEQKNFVGQEHLVHLVNQLQQDMKEASPGLESKEQTAHYVTGRALRGSDKVFEKWGKLAPDAPFDLYDAEIKNVQRRNTRRFGSHDLFAKLAEPEYQALWREDASFLTRYAVYNSILRKLNHAKMFATFTLPDATAHPIWTRFDKLGGNLHQYTFLFNEFGERRHAIRFHKLLKVENGVAREVDDVTVPISMSEQLDNLLPRDPNEPIALYFRDYGAEQHFTGEFGGAKIQCRRDQLAHMHRRRGARDVYLNVSVRVQSQSEARGERRPPYAAVFRLVGDNHRAFVHFDKLSDYLAEHPDDGKLGSEGLLSGLRVMSVDLGLRTSASISVFRVARKDELKPNSKGRVPFFFPIKGNDNLVAVHERSQLLKLPGETESKDLRAIREERQRTLRQLRTQLAYLRLLVRCGSEDVGRRERSWAKLIEQPVDAANHMTPDWREAFENELQKLKSLHGICSDKEWMDAVYESVRRVWRHMGKQVRDWRKDVRSGERPKIRGYAKDVVGGNSIEQIEYLERQYKFLKSWSFFGKVSGQVIRAEKGSRFAITLREHIDHAKEDRLKKLADRIIMEALGYVYALDERGKGKWVAKYPPCQLILLEELSEYQFNNDRPPSENNQLMQWSHRGVFQELINQAQVHDLLVGTMYAAFSSRFDARTGAPGIRCRRVPARCTQEHNPEPFPWWLNKFVVEHTLDACPLRADDLIPTGEGEIFVSPFSAEEGDFHQIHADLNAAQNLQQRLWSDFDISQIRLRCDWGEVDGELVLIPRLTGKRTADSYSNKVFYTNTGVTYYERERGKKRRKVFAQEKLSEEEAELLVEADEAREKSVVLMRDPSGIINRGNWTRQKEFWSMVNQRIEGYLVKQIRSRVPLQDSACENTGDI

SEQ ID NO: 693 - protein, 1389 aa, Leptotrichia shahii
MGNLFGHKRWYEVRDKKDFKIKRKVKVKRNYDGNKYILNINENNNKEKIDNNKFIRKYINYKKNDNILKEFTRKFHAGNILFKLKGKEGIIRIENNDDFLETEEVVLYIEAYGKSEKLKALGITKKKIIDEAIRQGITKDDKKIEIKRQENEEEIEIDIRDEYTNKTLNDCSIILRIIENDELETKKSIYEIFKNINMSLYKIIEKIIENETEKVFENRYYEEHLREKLLKDDKIDVILTNFMEIREKIKSNLEILGFVKFYLNVGGDKKKSKNKKMLVEKILNINVDLTVEDIADFVIKELEFWNITKRIEKVKKVNNEFLEKRRNRTYIKSYVLLDKHEKFKIERENKKDKIVKFFVENIKNNSIKEKIEKILAEFKIDELIKKLEKELKKGNCDTEIFGIFKKHYKVNFDSKKFSKKSDEEKELYKIIYRYLKGRIEKILVNEQKVRLKKMEKIEIEKILNESILSEKILKRVKQYTLEHIMYLGKLRHNDIDMTTVNTDDFSRLHAKEELDLELITFFASTNMELNKIFSRENINNDENIDFFGGDREKNYVLDKKILNSKIKIIRDLDFIDNKNNITNNFIRKFTKIGTNERNRILHAISKERDLQGTQDDYNKVINIIQNLKISDEEVSKALNLDVVFKDKKNIITKINDIKISEENNNDIKYLPSFSKVLPEILNLYRNNPKNEPFDTIETEKIVLNALIYVNKELYKKLILEDDLEENESKNIFLQELKKTLGNIDEIDENIIENYYKNAQISASKGNNKAIKKYQKKVIECYIGYLRKNYEELFDFSDFKMNIQEIKKQIKDINDNKTYERITVKTSDKTIVINDDFEYIISIFALLNSNAVINKIRNRFFATSVWLNTSEYQNIIDILDEIMQLNTLRNECITENWNLNLEEFIQKMKEIEKDFDDFKIQTKKEIFNNYYEDIKNNILTEFKDDINGCDVLEKKLEKIVIFDDETKFEIDKKSNILQDEQRKLSNINKKDLKKKVDQYIKDKDQEIKSKILCRIIFNSDFLKKYKKEIDNLIEDMESENENKFQEIYYPKERKNELYIYKKNLFLNIGNPNFDKIYGLISNDIKMADAKFLFNIDGKNIRKNKISEIDAILKNLNDKLNGYSKEYKEKYIKKLKENDDFFAKNIQNKNYKSFEKDYNRVSEYKKIRDLVEFNYLNKIESYLIDINWKLAIQMARFERDMHYIVNGLRELGIIKLSGYNTGISRAYPKRNGSDGFYTTTAYYKFFDEESYKKFEKICYGFGIDLSENSEINKPENESIRNYISHFYIVRNPFADYSIAEQIDRVSNLLSYSTRYNNSTYASVFEVFKKDVNLDYDELKKKFKLIGNNDILERLMKPKKVSVLELESYNSDYIKNLIIELLTKIENTNDTL

SEQ ID NO: 694 - protein, 1050 aa, Artificial Sequence
  Synthetic Polypeptide
MRSNYHGGRNARQWRKQISGLARRTKETVFTYKFPLETDAAEIDFDKAVQTYGIAEGVGHGSLIGLVCAFHLSGFRLFSKAGEAMAFRNRSRYPTDAFAEKLSAIMGIQLPTLSPEGLDLIFQSPPRSRDGIAPVWSENEVRNRLYTNWTGRGPANKPDEHLLEIAGEIAKQVFPKFGGWDDLASDPDKALAAADKYFQSQGDFPSIASLPAAIMLSPANSTVDFEGDYIAIDPAAETLLHQAVSRCAARLGRERPDLDQNKGPFVSSLQDALVSSQNNGLSWLFGVGFQHWKEKSPKELIDEYKVPADQHGAVTQVKSFVDAIPLNPLFDTTHYGEFRASVAGKVRSWVANYWKRLLDLKSLLATTEFTLPESISDPKAVSLFSGLLVDPQGLKKVADSLPARLVSAEEAIDRLMGVGIPTAADIAQVERVADEIGAFIGQVQQFNNQVKQKLENLQDADDEEFLKGLKIELPSGDKEPPAINRISGGAPDAAAEISELEEKLQRLLDARSEHFQTISEWAEENAVTLDPIAAMVELERLRLAERGATGDPEEYALRLLLQRIGRLANRVSPVSAGSIRELLKPVFMEEREFNLFFHNRLGSLYRSPYSTSRHQPFSIDVGKAKAIDWIAGLDQISSDIEKALSGAGEALGDQLRDWINLAGFAISQRLRGLPDTVPNALAQVRCPDDVRIPPLLAMLLEEDDIARDVCLKAFNLYVSAINGCLFGALREGFIVRTRFQRIGTDQIHYVPKDKAWEYPDRLNTAKGPINAAVSSDWIEKDGAVIKPVETVRNLSSTGFAGAGVSEYLVQAPHDWYTPLDLRDVAHLVTGLPVEKNITKLKRLTNRTAFRMVGASSFKTHLDSVLLSDKIKLGDFTIIIDQHYRQSVTYGGKVKISYEPERLQVEAAVPVVDTRDRTVPEPDTLFDHIVAIDLGERSVGFAVFDIKSCLRTGEVKPIHDNNGNPVVGTVAVPSIRRLMKAVRSHRRRRQPNQKVNQTYSTALQNYRENVIGDVCNRIDTLMERYNAFPVLEFQIKNFQAGAKQLEIVYGS

SEQ ID NO: 695 - protein, 345 aa, Sulfolobus islandicus
MEVPLYNIFGDNYIIQVATEAENSTIYNNKVEIDDEELRNVLNLAYKIAKNNEDAAAERRGKAKKKKGEEGETTTSNIILPLSGNDKNPWTETLKCYNFPTTVALSEVFKNFSQVKECEEVSAPSFVKPEFYEFGRSPGMVERTRRVKLEVEPHYLIIAAAGWVLTRLGKAKVSEGDYVGVNVFTPTRGILYSLIQNVNGIVPGIKPETAFGLWIARKVVSSVTNPNVSVVRIYTISDAVGQNPTTINGGFSIDLTKLLEKRYLLSERLEAIARNALSISSNMRERYIVLANYIYEYLTGSKRLEDLLYFANRDLIMNLNSDDGKVRDLKLISAYVNGELIRGEG

SEQ ID NO: 696 - protein, 345 aa, Sulfolobus islandicus
MEVPLYNIFGDNYIIQVATEAENSTIYNNKVEIDDEELRNVLNLAYKIAKNNEDAAAERRGKAKKKKGEEGETTTSNIILPLSGNDKNPWTETLKCYNFPTTVALSEVFKNFSQVKECEEVSAPSFVKPEFYKFGRSPGMVERTRRVKLEVEPHYLIMAAAGWVLTRLGKAKVSEGDYVGVNVFTPTRGILYSLIQNVNGIVPGIKPETAFGLWIARKVVSSVTNPNVSVVSIYTISDAVGQNPTTINGGFSIDLTKLLEKRDLLSERLEAIARNALSISSNMRERYIVLANYIYEYLTGSKRLEDLLYFANRDLIMNLNSDDGKVRDLKLISAYVNGELIRGEG

SEQ ID NO: 697 - protein, 1210 aa, Parcubacteria group bacterium
MSKRHPRISGVKGYRLHAQRLEYTGKSGAMRTIKYPLYSSPSGGRTVPREIVSAINDDYVGLYGLSNFDDLYNAEKRNEEKVYSVLDFWYDCVQYGAVFSYTAPGLLKNVAEVRGGSYELTKTLKGSHLYDELQIDKVIKFLNKKEISRANGSLDKLKKDIIDCFKAEYRERHKDQCNKLADDIKNAKKDAGASLGERQKKLFRDFFGISEQSENDKPSFTNPLNLTCCLLPFDTVNNNRNRGEVLFNKLKEYAQKLDKNEGSLEMWEYIGIGNSGTAFSNFLGEGFLGRLRENKITELKKAMMDITDAWRGQEQEEELEKRLRILAALTIKLREPKFDNHWGGYRSDINGKLSSWLQNYINQTVKIKEDLKGHKKDLKKAKEMINRFGESDTKEEAVVSSLLESIEKIVPDDSADDEKPDIPAIAIYRRFLSDGRLTLNRFVQREDVQEALIKERLEAEKKKKPKKRKKKSDAEDEKETIDFKELFPHLAKPLKLVPNFYGDSKRELYKKYKNAAIYTDALWKAVEKIYKSAFSSSLKNSFFDTDFDKDFFIKRLQKIFSVYRRFNTDKWKPIVKNSFAPYCDIVSLAENEVLYKPKQSRSRKSAAIDKNRVRLPSTENIAKAGIALARELSVAGFDWKDLLKKEEHEEYIDLIELHKTALALLLAVTETQLDISALDFVENGTVKDFMKTRDGNLVLEGRFLEMFSQSIVFSELRGLAGLMSRKEFITRSAIQTMNGKQAELLYIPHEFQSAKITTPKEMSRAFLDLAPAEFATSLEPESLSEKSLLKLKQMRYYPHYFGYELTRTGQGIDGGVAENALRLEKSPVKKREIKCKQYKTLGRGQNKIVLYVRSSYYQTQFLEWFLHRPKNVQTDVAVSGSFLIDEKKVKTRWNYDALTVALEPVSGSERVFVSQPFTIFPEKSAEEEGQRYLGIDIGEYGIAYTALEITGDSAKILDQNFISDPQLKTLREEVKGLKLDQRRGTFAMPSTKIARIRESLVHSLRNRIHHLALKHKAKIVYELEVSRFEEGKQKIKKVYATLKKADVYSEIDADKNLQTTVWGKLAVASEISASYTSQFCGACKKLWRAEMQVDETITTQELIGTVRVIKGGTLIDAIKDFMRPPIFDENDTPFPKYRDFCDKHHISKKMRGNSCLFICPFCRANADADIQASQTIALLRYVKEEKKVEDYFERFRKLKNIKVLGQMKKI

SEQ ID NO: 698 - protein, 1368 aa, Artificial Sequence
  Synthetic Polypeptide
MDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDAIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 699 - protein, 1052 aa, Artificial Sequence
  Synthetic Polypeptide
KRNYILGLDIGITSVGYGIIDYETRDVIDAGVRLFKEANVENNEGRRSKRGARRLKRRRRHRIQRVKKLLFDYNLLTDHSELSGINPYEARVKGLSQKLSEEEFSAALLHLAKRRGVHNVNEVEEDTGNELSTKEQISRNSKALEEKYVAELQLERLKKDGEVRGSINRFKTSDYVKEAKQLLKVQKAYHQLDQSFIDTYIDLLETRRTYYEGPGEGSPFGWKDIKEWYEMLMGHCTYFPEELRSVKYAYNADLYNALNDLNNLVITRDENEKLEYYEKFQIIENVFKQKKKPTLKQIAKEILVNEEDIKGYRVTSTGKPEFTNLKVYHDIKDITARKEIIENAELLDQIAKILTIYQSSEDIQEELTNLNSELTQEEIEQISNLKGYTGTHNLSLKAINLILDELWHTNDNQIAIFNRLKLVPKKVDLSQQKEIPTTLVDDFILSPVVKRSFIQSIKVINAIIKKYGLPNDIIIELAREKNSKDAQKMINEMQKRNRQTNERIEEIIRTTGKENAKYLIEKIKLHDMQEGKCLYSLEAIPLEDLLNNPFNYEVDHIIPRSVSFDNSFNNKVLVKQEENSKKGNRTPFQYLSSSDSKISYETFKKHILNLAKGKGRISKTKKEYLLEERDINRFSVQKDFINRNLVDTRYATRGLMNLLRSYFRVNNLDVKVKSINGGFTSFLRRKWKFKKERNKGYKHHAEDALIIANADFIFKEWKKLDKAKKVMENQMFEEKQAESMPEIETEQEYKEIFITPHQIKHIKDFKDYKYSHRVDKKPNRELINDTLYSTRKDDKGNTLIVNNLNGLYDKDNDKLKKLINKSPEKLLMYHHDPQTYQKLKLIMEQYGDEKNPLYKYYEETGNYLTKYSKKDNGPVIKKIKYYGNKLNAHLDITDDYPNSRNKVVKLSLKPYRFDVYLDNGVYKFVTVKNLDVIKKENYYEVNSKCYEEAKKLKKISNQAEFIASFYNNDLIKINGELYRVIGVNNDLLNRIEVNMIDITYREYLENMNDKRPPRIIKTIASKTQSIKKYSTDILGNLYEVKSKKHPQIIKKG

SEQ ID NO: 700 - protein, 1052 aa, Artificial Sequence
  Synthetic Polypeptide
KRNYILGLDIGITSVGYGIIDYETRDVIDAGVRLFKEANVENNEGRRSKRGARRLKRRRRHRIQRVKKLLFDYNLLTDHSELSGINPYEARVKGLSQKLSEEEFSAALLHLAKRRGVHNVNEVEEDTGNELSTKEQISRNSKALEEKYVAELQLERLKKDGEVRGSINRFKTSDYVKEAKQLLKVQKAYHQLDQSFIDTYIDLLETRRTYYEGPGEGSPFGWKDIKEWYEMLMGHCTYFPEELRSVKYAYNADLYNALNDLNNLVITRDENEKLEYYEKFQIIENVFKQKKKPTLKQIAKEILVNEEDIKGYRVTSTGKPEFTNLKVYHDIKDITARKEIIENAELLDQIAKILTIYQSSEDIQEELTNLNSELTQEEIEQISNLKGYTGTHNLSLKAINLILDELWHTNDNQIAIFNRLKLVPKKVDLSQQKEIPTTLVDDFILSPVVKRSFIQSIKVINAIIKKYGLPNDIIIELAREKNSKDAQKMINEMQKRNRQTNERIEEIIRTTGKENAKYLIEKIKLHDMQEGKCLYSLEAIPLEDLLNNPFNYEVDHIIPRSVSFDNSFNNKVLVKQEEASKKGNRTPFQYLSSSDSKISYETFKKHILNLAKGKGRISKTKKEYLLEERDINRFSVQKDFINRNLVDTRYATRGLMNLLRSYFRVNNLDVKVKSINGGFTSFLRRKWKFKKERNKGYKHHAEDALIIANADFIFKEWKKLDKAKKVMENQMFEEKQAESMPEIETEQEYKEIFITPHQIKHIKDFKDYKYSHRVDKKPNRELINDTLYSTRKDDKGNTLIVNNLNGLYDKDNDKLKKLINKSPEKLLMYHHDPQTYQKLKLIMEQYGDEKNPLYKYYEETGNYLTKYSKKDNGPVIKKIKYYGNKLNAHLDITDDYPNSRNKVVKLSLKPYRFDVYLDNGVYKFVTVKNLDVIKKENYYEVNSKCYEEAKKLKKISNQAEFIASFYNNDLIKINGELYRVIGVNNDLLNRIEVNMIDITYREYLENMNDKRPPRIIKTIASKTQSIKKYSTDILGNLYEVKSKKHPQIIKKG

SEQ ID NO: 701 - protein, 1052 aa, Artificial Sequence
  Synthetic Polypeptide
KRNYILGLDIGITSVGYGIIDYETRDVIDAGVRLFKEANVENNEGRRSKRGARRLKRRRRHRIQRVKKLLFDYNLLTDHSELSGINPYEARVKGLSQKLSEEEFSAALLHLAKRRGVHNVNEVEEDTGNELSTKEQISRNSKALEEKYVAELQLERLKKDGEVRGSINRFKTSDYVKEAKQLLKVQKAYHQLDQSFIDTYIDLLETRRTYYEGPGEGSPFGWKDIKEWYEMLMGHCTYFPEELRSVKYAYNADLYNALNDLNNLVITRDENEKLEYYEKFQIIENVFKQKKKPTLKQIAKEILVNEEDIKGYRVTSTGKPEFTNLKVYHDIKDITARKEIIENAELLDQIAKILTIYQSSEDIQEELTNLNSELTQEEIEQISNLKGYTGTHNLSLKAINLILDELWHTNDNQIAIFNRLKLVPKKVDLSQQKEIPTTLVDDFILSPVVKRSFIQSIKVINAIIKKYGLPNDIIIELAREKNSKDAQKMINEMQKRNRQTNERIEEIIRTTGKENAKYLIEKIKLHDMQEGKCLYSLEAIPLEDLLNNPFNYEVDHIIPRSVSFDNSFNNKVLVKQEEASKKGNRTPFQYLSSSDSKISYETFKKHILNLAKGKGRISKTKKEYLLEERDINRFSVQKDFINRNLVDTRYATRGLMNLLRSYFRVNNLDVKVKSINGGFTSFLRRKWKFKKERNKGYKHHAEDALIIANADFIFKEWKKLDKAKKVMENQMFEEKQAESMPEIETEQEYKEIFITPHQIKHIKDFKDYKYSHRVDKKPNRKLINDTLYSTRKDDKGNTLIVNNLNGLYDKDNDKLKKLINKSPEKLLMYHHDPQTYQKLKLIMEQYGDEKNPLYKYYEETGNYLTKYSKKDNGPVIKKIKYYGNKLNAHLDITDDYPNSRNKVVKLSLKPYRFDVYLDNGVYKFVTVKNLDVIKKENYYEVNSKCYEEAKKLKKISNQAEFIASFYKNDLIKINGELYRVIGVNNDLLNRIEVNMIDITYREYLENMNDKRPPHIIKTIASKTQSIKKYSTDILGNLYEVKSKKHPQIIKKG

SEQ ID NO: 702 - protein, 1052 aa, Artificial Sequence
  Synthetic Polypeptide
KRNYILGLAIGITSVGYGIIDYETRDVIDAGVRLFKEANVENNEGRRSKRGARRLKRRRRHRIQRVKKLLFDYNLLTDHSELSGINPYEARVKGLSQKLSEEEFSAALLHLAKRRGVHNVNEVEEDTGNELSTKEQISRNSKALEEKYVAELQLERLKKDGEVRGSINRFKTSDYVKEAKQLLKVQKAYHQLDQSFIDTYIDLLETRRTYYEGPGEGSPFGWKDIKEWYEMLMGHCTYFPEELRSVKYAYNADLYNALNDLNNLVITRDENEKLEYYEKFQIIENVFKQKKKPTLKQIAKEILVNEEDIKGYRVTSTGKPEFTNLKVYHDIKDITARKEIIENAELLDQIAKILTIYQSSEDIQEELTNLNSELTQEEIEQISNLKGYTGTHNLSLKAINLILDELWHTNDNQIAIFNRLKLVPKKVDLSQQKEIPTTLVDDFILSPVVKRSFIQSIKVINAIIKKYGLPNDIIIELAREKNSKDAQKMINEMQKRNRQTNERIEEIIRTTGKENAKYLIEKIKLHDMQEGKCLYSLEAIPLEDLLNNPFNYEVDHIIPRSVSFDNSFNNKVLVKQEENSKKGNRTPFQYLSSSDSKISYETFKKHILNLAKGKGRISKTKKEYLLEERDINRFSVQKDFINRNLVDTRYATRGLMNLLRSYFRVNNLDVKVKSINGGFTSFLRRKWKFKKERNKGYKHHAEDALIIANADFIFKEWKKLDKAKKVMENQMFEEKQAESMPEIETEQEYKEIFITPHQIKHIKDFKDYKYSHRVDKKPNRELINDTLYSTRKDDKGNTLIVNNLNGLYDKDNDKLKKLINKSPEKLLMYHHDPQTYQKLKLIMEQYGDEKNPLYKYYEETGNYLTKYSKKDNGPVIKKIKYYGNKLNAHLDITDDYPNSRNKVVKLSLKPYRFDVYLDNGVYKFVTVKNLDVIKKENYYEVNSKCYEEAKKLKKISNQAEFIASFYNNDLIKINGELYRVIGVNNDLLNRIEVNMIDITYREYLENMNDKRPPRIIKTIASKTQSIKKYSTDILGNLYEVKSKKHPQIIKKG

SEQ ID NO: 703 - protein, 1367 aa, Artificial Sequence
  Synthetic Polypeptide
DKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 704 - protein, 1367 aa, Artificial Sequence
  Synthetic Polypeptide
DKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 705 - protein, 1367 aa, Artificial Sequence
  Synthetic Polypeptide
DKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFESPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKQYRSTKEVLDATLIHQSITGLYETRIDLSQLGGD

SEQ ID NO: 706 - protein, 1367 aa, Artificial Sequence
  Synthetic Polypeptide
DKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFVSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKQYRSTKEVLDATLIHQSITGLYETRIDLSQLGGD

SEQ ID NO: 707 - protein, 1367 aa, Artificial Sequence
  Synthetic Polypeptide
DKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFVSPTVAYSVLVVAKVEKGKSKKLKSVKELLGITIMERSSFEKNPIDFLEAKGYKEVKKDLIIKLPKYSLFELENGRKRMLASARELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKEYRSTKEVLDATLIHQSITGLYETRIDLSQLGGD

SEQ ID NO: 708 - protein, 1367 aa, Artificial Sequence; identical to SEQ ID NO: 338
  Synthetic Polypeptide

SEQ ID NO: 709 - protein, 1612 aa, Artificial Sequence; identical to SEQ ID NO: 339
  Synthetic Polypeptide

SEQ ID NO: 710 - protein, 173 aa, Gam form bacteriophage Mu
AKPAKRIKSAAAAYVPQNRDAVITDIKRIGDLQREASRLETEMNDAIAEITEKFAARIAPIKTDIETLSKGVQGWCEANRDELTNGGKVKTANLVTGDVSWRVRPPSVSIRGMDAVMETLERLGLQRFIRTKQEINKEAILLEPKAVAGVAGITVKSGIEDFSIIPFEQEAGI

SEQ ID NO: 711 - protein, 174 aa, Enterobacteriaceae
MAKPAKRIKSAAAAYVPQNRDAVITDIKRIGDLQREASRLETEMNDAIAEITEKFAARIAPIKTDIETLSKGVQGWCEANRDELTNGGKVKTANLVTGDVSWRVRPPSVSIRGMDAVMETLERLGLQRFIRTKQEINKEAILLEPKAVAGVAGITVKSGIEDFSIIPFEQEAGI

SEQ ID NO: 712 - protein, 174 aa, Escherichia virus Mu
MAKPAKRIKSAAAAYVPQNRDAVITDIKRIGDLQREASRLETEMNDAIAEITEKFAARIAPIKTDIETLSKGVQGWCEANRDELTNGGKVKTANLVTGDVSWRVRPPSVSIRGMDAVMETLERLGLQRFVRTKQEINKEAILLEPKAVAGVAGITVKSGIEDFSIIPFEQEAGI

SEQ ID NO: 713 - protein, 174 aa, Escherichia coli
MAKPAKRIKSAAAAYVPQNRDAVITDIKRIGDLQREASRLETEMNDAIAEITEKFAARIAPLKTDIETLSKGVQGWCEANRDELTNGGKVKTANLVTGDVSWRVRPPSVSIRGMDAVMETLERLGLQRFIRTKQEINKEAILLEPKAVAGVAGITVKSGIEDFSIIPFEQEAGI

SEQ ID NO: 714 - protein, 174 aa, Escherichia coli
MAKPAKRIKSAAAAYVPQNRDAVITDIKRIGDLQREASRLETEMNDAIAEITEKFAARIAPIKTDIETLSKGVQGWCEANRDELTNGGKVKTANLITGDVSWRVRPPSVSIRGMDAVMETLERLGLQRFIRTKQEINKEAILLEPKAVAGVAGITVKSGIEDFSIIPFEQEAGI

SEQ ID NO: 715 - protein, 174 aa, Shigella sonnei
MAKPAKRIRNAAAAYVPQSRDAVVCDIRRIGDLQREAARLETEMNDAIAEITEKYASQIAPLKTSIETLSKGVQGWCEANRDELTNGGKVKTANLVTGDVSWRQRPPSVSIRGVDAVMETLERLGLQRFIRTKQEINKEAILLEPKAVAGVAGITVKSGIEDFSIIPFEQEAGI

SEQ ID NO: 716 - protein, 174 aa, Escherichia coli
MAKPAKRIKNAAAAYVPQSRDAVVCDIRRIGDLQREAARLETEMNDAIAEITEKYASQIAPLKTSIETISKGVQGWCEANRDELTNGGKVKTANLVTGDVSWRQRPPSVSIRGVDAVMETLERLGLQRFIRTKQEINKEAILLEPKAVAGVAGITVKSGIEDFSIIPFEQEAGI

SEQ ID NO: 717 - protein, 174 aa, Escherichia coli
MAKPAKRIKNAAAAYVPQSRDAVVCDIRRIGDLQREAARLETEMNDAIADITEKYASQIAPLKTSIETLSKGVQGWCEANRDELTNGGKVKTANLVTGDVSWRQRPPSVSIRGVDAVMETLERLGLQRFIRTKQEINKEAILLEPKAVAGVAGITVKSGIEDFSIIPFEQEAGI

SEQ ID NO: 718 - protein, 174 aa, Escherichia coli
MAKSAKRIRNAAAAYVPQSRDAVVCDIRRIGNLQREAARLETEMNDAIAEITEKFAARIAPLKTDIETLSKGVQGWCEANRDELTNGGKVKTANLVTGDVSWRQRPPSVSIRGVDAVMETLERLGLQRFIRTKQEINREAILLEPKAVAGVAGITVKSGIEDFSIIPFEQDAGI

SEQ ID NO: 719 - protein, 174 aa, Shigella sonnei
MAKPAKRIRNAAAAYVPQSRDAVVCDIRRIGDLQREAARLETEMNDAIAEITEKYASQIAPLKTSIETLSKGVQGWCEANRDELTNGGKVKTANLVTGDVSWRQRPPSVSIRGVDAVMETLERLGLQRFIRTKQEINKEAILLEPKAVAGVAGITVKSGIEDFSIIPFEQDAGI

SEQ ID NO: 720 - protein, 174 aa, Escherichia coli
MAKPAKRIKNAAAAYVPQSRDAVVCDIRRIGDLQREAARLETEMNDAIAEITEKYASQIAPLKTSIETLSKGVQGWCEANRDELTNGGKVKTANLVTGDVSWRLRPPSVSIRGVDAVMETLERLGLQRFICTKQEINKEAILLEPKVVAGVAGITVKSGIEDFSIIPFEQEAGI

SEQ ID NO: 721 - protein, 174 aa, Escherichia coli
MAKPVKRIRNAAAAYVPQSRDAVVCDIRRIGDLQREAARLETEMNDAIAEITEKYASQIAPLKTSIETLSKGIQGWCEANRDELTNGGKVKTANLVTGDVSWRQRPPSVSIRGVDAVMETLERLGLQRFIRTKQEINKEAILLEPKAVAGVAGITVKSGIEDFSIIPFEQEAGI

SEQ ID NO: 722 - protein, 174 aa, Escherichia coli
MAKPAKRIRNAAAAYVPQSRDAVVCDIRWIGDLQREAVRLETEMNDAIAEITEKYASRIAPLKTRIETLSKGVQGWCEANRDELTNGGKVKTANLVTGDVSWRQRPPSVSIRGVDAVMETLERLGLQRFIRTKQEINKEAILLEPKAVAGVAGITVKSGIEDFSIIPFEQEAGI

SEQ ID NO: 723 - protein, 174 aa, Escherichia coli
MAKSAKRIRNAAATYVPQSRDAVVCDIRRIGDLQREAARLETEMNDAIAEITEKYASQIAPLKTSIETLSKGIQGWCEANRDELTNGGKVKTANLVTGDVSWRQRPPSVSIRGVDAVMETLERLGLQRFIRTKQEINKEAILLEPKAVAGVAGITVKSGIEDFSIIPFEQEAGI

SEQ ID NO: 724 - protein, 174 aa, Salmonella enterica
MAKSAKRIKSAAATYVPQSRDAVVCDIRRIGDLQREAARLETEMNDAIAEITEKYASQIAPLKTSIETLSKGVQGWCEANRDELTNGGKVKSANLVTGDVQWRQRPPSVSIRGVDAVMETLERLGLQRFIRTKQEINKEAILLEPKAVAGVAGITVKSGIEDFSIIPFEQEAGI

SEQ ID NO: 725 - protein, 174 aa, Shigella sonnei
MAKSAKRIRNAAAAYVPQSRDAVVCDIRRIGNLQREAARLETEMNDAIAEITEKYASQIAPLKTSIETLSKGVQGWCEANRDELTNGGKVKTANLVTGDVSWRQRPPSVSIRGVDAVMETLERLGLQRFIRTKQEINKEAILLEPKAVAGVAGITVKSGIEDFSIIPFEQDAGI

SEQ ID NO: 726 - protein, 165 aa, Shigella flexneri
MVVSAIASTPHDAVVCDIRRIGDLQREAARLETEMNDAIAEITEKDASQIAPLKTSIETLSKGVQGWCEANRDELTNGGKVKTANLVTGDVSWRQRPPSVSIRGVDAVMETLERLGLQRFIRTKQEINKEAILLEPKAVAGVAGITVKSGIEDFSIIPFEQEAGI

SEQ ID NO: 727 - protein, 174 aa, Kluyvera georgiana
MVSKPKRIKAAAANYVSQSRDAVITDIRKIGDLQREATRLESAMNDEIAVITEKYAGLIKPLKADVEMLSKGVQGWCEANRDDLTSNGKVKTANLVTGDIQWRIRPPSVSVRGPDAVMETLTRLGLSRFIRTKQEINKEAILNEPLAVAGVAGITVKSGIEDFSIIPFEQTADI

SEQ ID NO: 728 - protein, 174 aa, Edwardsiella tarda
MASKPKRIKSAAANYVSQSRDAVIIDIRKIGDLQREATRLESAMNDEIAVITEKYAGLIKPLKADVEMLSKGVQGWCEANRDELTCNGKVKTANLVTGDIQWRIRPPSVSVRGPDSVMETLLRLGLSRFIRTKQEINKEAILNEPLAVAGVAGITVKTGVEDFSIIPFEQTADI

SEQ ID NO: 729 - protein, 174 aa, Citrobacter freundii
MVSKPKRIKAAAANYVSQSKEAVIADIRKIGDLQREATRLESAMNDEIAVITEKYAGLIKPLKTDVEILSKGVQGWCEANRDELTSNGKVKTANLVTGDIQWRIRPPSVAVRGPDAVMETLLRLGLSRFIRTKQEINKEAILNEPLAVAGVAGITVKSGVEDFSIIPFEQTADI

SEQ ID NO: 730 - protein, 174 aa, Salmonella enterica
MASKPKRIKAAAALYVSQSREDVVRDIRMIGDFQREIVRLETEMNDQIAAVTLKYADKIKPLQEQLKTLSEGVQNWCEANRSDLTNGGKVKTANLVTGDVQWRVRPPSVTVRGVDSVMETLRRLGLSRFIRIKEEINKEAILNEPGAVAGVAGITVKSGVEDFSIIPFEQSATN

SEQ ID NO: 731 - protein, 172 aa, Pasteurella multocida
MAKKATRIKTTAQVYVPQSREDVASDIKTIGDLNREITRLETEMNDKIAEITESYKGQFSPIQERIKNLSTGVQFWAEANRDQITNGGKTKTANLITGEVSWRVRNPSVKITGVDSVLQNLKIHGLTKFIRVKEEINKEAILNEKHEVAGIAGIKVVSGVEDFVITPFEQEI

SEQ ID NO: 732 - protein, 173 aa, Aggregatibacter actinomycetemcomitans
MAKSATRVKATAQIYVPQTREDAAGDIKTIGDLNREVARLEAEMNDKIAAITEDYKDKFAPLQERIKTLSNGVQYWSEANRDQITNGGKTKTANLVTGEVSWRVRNPSVKVTGVDSVLQNLRIHGLERFIRTKEEINKEAILNEKSAVAGIAGIKVITGVEDFVITPFEQEAA

SEQ ID NO: 733 - protein, 173 aa, Nitrosomonas halophila
MARNAARLKTKSIAYVPQSRDDAAADIRKIGDLQRQLTRTSTEMNDAIAAITQNFQPRMDAIKEQINLLQAGVQGYCEAHRHALTDNGRVKTANLITGEVQWRQRPPSVSIRGQQVVLETLRRLGLERFIRTKEEVNKEAILNEPDEVRGVAGLNVITGVEDFVITPFEQEQP

SEQ ID NO: 734 - protein, 172 aa, Wohlfahrtiimonas larvae
MAKKRIKAAATVYVPQSKEEVQNDIREIGDISRKNERLETEMNDRIAEITNEYAPKFEVNKVRLELLTKGVQSWCEANRDDLTNSGKVKSANLVTGKVEWRQRPPSISVKGMDAVIEWLQDSKYQRFLRTKVEVNKEAMLNEPEDAKTIPGITIKSGIEDFAITPFEQEAGV

SEQ ID NO: 735 - DNA, 21 bp, Artificial Sequence
  Synthetic Polynucleotide
tacagtcagtatcaattctgg

SEQ ID NO: 736 - DNA, 6 bp, Artificial Sequence
  Synthetic Polynucleotide
aagaat

SEQ ID NO: 737 - protein, 7 aa, Artificial Sequence
  Synthetic Polypeptide
KKTGDQK

SEQ ID NO: 738 - DNA, 32 bp, Artificial Sequence
  Synthetic Polynucleotide
ttccatacagtcagtatcaattctggaagaat

SEQ ID NO: 739 - DNA, 42 bp, Artificial Sequence
  Synthetic Polynucleotide
tacagtcagtatcaattctggaagaatttccagacattaaag

SEQ ID NO: 740 - protein, 14 aa, Artificial Sequence
  Synthetic Polypeptide
YSQYQFWKNFQTLK

SEQ ID NO: 741 - DNA, 42 bp, Artificial Sequence
  Synthetic Polynucleotide
ctttaatgtctggaaattcttccagaattgatactgactgta

What is claimed is:

1. A method of editing a polynucleotide encoding a C—C chemokine receptor type five (CCR5) protein, the method comprising contacting the CCR5-encoding polynucleotide with:
  (i) a fusion protein comprising: (a) a guide nucleotide sequence-programmable DNA binding protein domain; (b) a cytosine deaminase domain, and (c) a uracil glycosylase inhibitor (UGI) domain; and
  (ii) a guide nucleotide sequence targeting the fusion protein of (i) to a target cytosine (C) base in the CCR5-encoding polynucleotide;
wherein the contacting results in the deamination of the target C base by the fusion protein, resulting in a cytosine-guanine (C:G) to thymine-adenine pair (T:A) change in the CCR5-encoding polynucleotide.

2. The method of claim 1, wherein the guide nucleotide sequence-programmable DNA binding protein is a nickase.

3. The method of claim 1, wherein the guide nucleotide sequence-programmable DNA binding protein is a Cas9 nickase.

4. The method of claim 3, wherein the Cas9 nickase comprises a mutation corresponding to a D10A mutation or an H840A mutation in SEQ ID NO: 1.

5. The method of claim 3, wherein the Cas9 nickase comprises a mutation corresponding to a D10A mutation in SEQ ID NO: 1.

6. The method of claim 1, wherein the guide nucleotide sequence-programmable DNA binding protein domain is selected from the group consisting of: a nuclease inactive Cas9 (dCas9) domain, a nuclease inactive Cpf1 domain, a nuclease inactive Argonaute domain, and variants and combinations thereof.

7. The method of claim 6, wherein the guide nucleotide sequence-programmable DNA-binding protein domain comprises a nuclease inactive Cpf1 (dCpf1) domain.

8. The method of claim 6, wherein the guide nucleotide sequence-programmable DNA-binding protein domain comprises a nuclease inactive Argonaute (dAgo) domain.

9. The method of claim 1, wherein the cytosine deaminase domain comprises an apolipoprotein B mRNA-editing complex (APOBEC) family deaminase.

10. The method of claim 1, wherein the fusion protein of (i) further comprises a Gam protein.

11. The method of claim 10, wherein the Gam protein comprises the amino acid sequence of any one of SEQ ID NOs: 710-734.

12. The method of claim 1, wherein the polynucleotide encoding the CCR5 protein comprises a coding strand and a complementary strand.

13. The method of claim 1, wherein the C to T change in the CCR5-encoding polynucleotide leads to a mutation in the CCR5 protein.

14. The method of claim 13, wherein the mutation is selected from any one of the mutations listed in Tables 1-9.

15. The method of claim 13, wherein the mutation is a premature stop codon that leads to a truncated or non-functional CCR5 protein.

16. The method of claim 13, wherein the mutation destabilizes CCR5 protein folding.

17. The method of claim 1, wherein the C to T change modifies a splicing site in the CCR5-encoding polynucleotide.

18. The method of claim 1, wherein the guide nucleotide sequence is RNA (gRNA).

19. The method of claim 1, wherein the guide nucleotide sequence comprises a guide-RNA sequence listed in any one of Tables 3, 4, 5, 8, or 9.

20. The method of claim 1, wherein the UGI domain is fused to the dCas9 domain via a linker.

21. The method of claim 1, wherein the fusion protein comprises the structure $NH_2$-[cytosine deaminase domain]-[optional linker sequence]-[guide nucleotide sequence-programmable DNA-binding protein domain]-[optional linker sequence]-[UGI domain]-COOH.

22. The method of claim 1, wherein the cytosine deaminase is selected from the group consisting of APOBEC1, APOBEC2, APOBEC3A, APOBEC3B, APOBEC3C, APOBEC3D, APOBEC3F, APOBEC3G deaminase, APOBEC3H deaminase, APOBEC4 deaminase, activation-induced deaminase (AID), and pmCDA1.

23. The method of claim 1, wherein the cytosine deaminase comprises the amino acid sequence of any one of SEQ ID NOs: 1-260, 270-292, or 315-323.

24. The method of claim 1, wherein the fusion protein comprises the amino acid sequence of any one of SEQ ID NO: 293-302.

25. The method of claim 1, wherein the guide nucleotide sequence is a single guide RNA (sgRNA).

* * * * *